US011371052B2

(12) United States Patent
Raab et al.

(10) Patent No.: US 11,371,052 B2
(45) Date of Patent: Jun. 28, 2022

(54) PHYTASE PRODUCTION AND METHODS OF USING THE SAME

(71) Applicant: AGRIVIDA, INC., Woburn, MA (US)

(72) Inventors: R. Michael Raab, Arlington, MA (US); Oleg Bougri, Winchester, MA (US); Philip A. Lessard, Framingham, MA (US); Christopher Bonin, South Windsor, CT (US); Michael B. Lanahan, Cary, NC (US)

(73) Assignee: AGRIVIDA, INC., Woburn, MA (US)

( * ) Notice: Subject to any disclaimer, the term of this patent is extended or adjusted under 35 U.S.C. 154(b) by 0 days.

(21) Appl. No.: 16/344,559

(22) PCT Filed: Nov. 3, 2017

(86) PCT No.: PCT/US2017/059903
§ 371 (c)(1),
(2) Date: Apr. 24, 2019

(87) PCT Pub. No.: WO2018/089264
PCT Pub. Date: May 17, 2018

(65) Prior Publication Data
US 2020/0299709 A1    Sep. 24, 2020

Related U.S. Application Data

(60) Provisional application No. 62/419,136, filed on Nov. 8, 2016.

(51) Int. Cl.
| | | |
|---|---|---|
| *C12N 15/82* | (2006.01) | |
| *A23K 20/142* | (2016.01) | |
| *A23K 20/174* | (2016.01) | |
| *A23K 20/189* | (2016.01) | |
| *A23K 20/22* | (2016.01) | |
| *A23K 20/26* | (2016.01) | |
| *A23K 20/28* | (2016.01) | |
| *A23K 50/10* | (2016.01) | |
| *A23K 50/75* | (2016.01) | |
| *A23K 10/37* | (2016.01) | |
| *A23K 20/20* | (2016.01) | |

(52) U.S. Cl.
CPC .......... *C12N 15/8243* (2013.01); *A23K 10/37* (2016.05); *A23K 20/142* (2016.05); *A23K 20/174* (2016.05); *A23K 20/189* (2016.05); *A23K 20/22* (2016.05); *A23K 20/26* (2016.05); *A23K 20/28* (2016.05); *A23K 50/10* (2016.05); *A23K 50/75* (2016.05); *A23K 20/30* (2016.05); *C12Y 301/03* (2013.01)

(58) Field of Classification Search
CPC ............................................... C12N 15/8242
See application file for complete search history.

(56) References Cited

U.S. PATENT DOCUMENTS

| | | | | |
|---|---|---|---|---|
| 7,141,717 | B2 * | 11/2006 | Lanahan | ............... C12N 9/16 |
| | | | | 800/278 |
| 7,317,138 | B2 * | 1/2008 | Lanahan | .............. A23K 40/25 |
| | | | | 800/278 |
| 2010/0273198 | A1 | 10/2010 | Basu et al. | |
| 2014/0259211 | A1 | 9/2014 | Brinch-Pedersen et al. | |

FOREIGN PATENT DOCUMENTS

| | | |
|---|---|---|
| AU | 2013204082 A1 | 5/2013 |
| AU | 2013254902 A1 | 11/2013 |
| CL | 200803596 | 5/2009 |
| CN | 1240477 A | 1/2000 |
| CN | 1622825 A1 | 6/2005 |
| FR | 2751987 A1 | 2/1998 |
| WO | 98/05785 A1 | 2/1998 |
| WO | 2003/057248 A1 | 7/2003 |
| WO | 2006/098952 A2 | 9/2006 |
| WO | 2007/002192 A2 | 1/2007 |
| WO | 2009/100188 A2 | 8/2009 |
| WO | 2009/110933 A2 | 9/2009 |
| WO | 2016/054039 A1 | 4/2016 |
| WO | 2016183467 A1 | 11/2016 |

OTHER PUBLICATIONS

Garrett et al., Applied and Environmental Microbiology, May 2004; pp. 3041-3046. (Year: 2004).*
Gao et al., 2014, Effect of Dietary Phytase Transgenic Corn on Physiological Characteristics and the Fate of Recombinant Plant DNA in Layig Hens, Asian-Australasian Journal of Animal Sciences, 27(1): 77-82.
English Translation of Search Report dated Apr. 27, 2020 for the Chilean Application No. 201901225, consisting of 2 pp.
English Translation of Expert Examiner Report dated Apr. 27, 2020 for the Chilean Application No. 201901225, consisting of 8 pp.
Lu et al., 2015, Influence of Phytase Transgenic Corn on the Intestinal Microflora and the Fate of Transgenic DNA and Protein in Digesta and Tissues of Broilers, PLoS ONE, vol. 10, No. 11, pp. 1-17.
International Search Report dated Mar. 20, 2018 for PCT Patent Application PCT/2017/059903, consisting of 6 op.

(Continued)

*Primary Examiner* — Russell Kallis
(74) *Attorney, Agent, or Firm* — Volpe Koenig

(57) ABSTRACT

Methods and compositions are described for producing a phytase in transgenic maize plants and then incorporating parts of the transgenic maize plants in animal feed. The feed phytase enzyme displays activity across a broad pH range, and tolerance to temperatures that are often encountered during the process of preparing animal feeds. Methods of producing an animal feed that incorporate the transgenic maize plants, parts thereof or plant derived phytases, as well as methods of promoting the release of inorganic phosphate from a phytic acid in an animal, producing an animal meat, or reducing the ratio of intake of an animal feed per weight of the animal meat by feeding an animal with the animal feed incorporating transgenic maize plants are provided.

1 Claim, 23 Drawing Sheets

Specification includes a Sequence Listing.

(56) References Cited

OTHER PUBLICATIONS

Written Opinion dated Mar. 20, 2018 for PCT Patent Application PCT/2017/059903, consisting of 8 pp.
Arakawa, T., Chong, D. K., & Langridge, W. H. (1998). Efficacy of a food plant-based oral cholera toxin B subunit vaccine. Nature Biotechnology, 16(3), 292-297. doi:10 1038/nbt0398-292.
Sievers et al. (2011) Molecular Systems Biology 7: 539 doi: 10.1038/ msb. 2011.75.
Cervelli, M., Di Caro, O., Di Penta, A., Angelini, R., Federico, R., Vitale, A., & Mariottini, P. (2004). A novel C-terminal sequence from barley polyamine oxidase is a vacuolar sorting signal. Plant Journal, 40(3), 410-418. doi: 10.1111/i.1365-313X.2004.02221.X.
Haq, T. a, Mason, H. S., Clements, J. D., & Arntzen, C. J. (1995). Oral immunization with a recombinant bacterial antigen produced in transgenic plants. Science (New York, N.Y.), 268(5211), 714 716 doi:10.1126/science.7732379.
Lawrence, CJ, Dong, Q, Polacco, ML, Seigfried, TE, and Brendel, V. (2004) MaizeGDB, the community database for maize genetics and genomics. Nucleic Acids Research 32:D393-D397.
Korban, S. S. (2002). Targeting and expression of antigenic proteins in transgenic plants for production of edible oral vaccines. In Vitro Cellular & Developmental Biology—Plant, 38(3), 231-236 doi:10.1079/IVP2002292.
Munro, S., & Pelham, H. R. (1987). A C-terminal signal prevents secretion of luminal ER proteins. Cell, 48(5), 899-907. doi: 10.1016/ 0092-8674(87)90086-9.
Smith TF, Waterman MS 1981 "Identification of Common Molecular Subsequences," Journal of Molecular Biology 147: 195-197.
Thomas K, Aalbers M, Bannon GA, Bartels M, Dearman RJ, Esdaile DJ, et al. A multi-laboratory evaluation of a common in vitro pepsin digestion assay protocol used in assessing the safety of novel proteins. Reg Toxicol Pharmacol. 2004;2:87-98.
Cozannet et al, Energy value of wheat distillers grains with solubles for growing pigs and adult sows. 2010 J. Anim, Sci., 88(7):2382-2392.
Sibbald, IR. This Week's Citation Classic. 1976, Poultry Science 55: 303-308.
Hill, F. W., and D. L. Anderson, 1958, "Comparison of metabolizable energy and productive energy determinations with growing chicks." J. Nutr. 64:587-603.
Nutrient Requirements of Poultry, 1994, National Research Council, National Academy Press, Washington, D.C.
Broiler Performance and Nutrition Supplement, Cobb-500™, L-2114-07EN, Jul. 2015.
Broiler Performance and Nutrition Supplement, Cobb-700™, L-21124-13EN, Dec. 21, 2012.
Broiler Performance and Nutrition Supplement, CobbAvian™, L-2144-04EN, Apr. 2012.
Broiler Performance and Nutrition Supplement, CobbSasso™, L-2154-01, May 7, 2008.
Ross 308 Broiler: Nutrition Specifications, 2014 Aviagen, 0814-AVNR-035.
Ross Nutrition Supplement 2009, Aviagen.
Ross 708 Broiler: Nutrition Specification, 2014 Aviagen, 0814-AVNR-036.
Ross PM3 Brioler Nutrition Specification, 2014 Aviagen, 0814-AVNR-037.
Arbor Acres Plus Broiler Nutrition Specifications, 2014 Aviagen, 1014 AVNAA 043; Arbor Acres Broiler Nutrition Supplement, 2009 Aviagen; and Association of American Feed Control Officials (AAFCO) 2015 Official Publication, Nutrient Requirements for Poultry.
Search Report dated Sep. 22, 2020 for the European Patent Application No. 17869615.9.
Written Opinion dated Sep. 22, 2020 for the European Patent Application No. 17869615.9.
English Translation of Search Report dated Mar. 3, 2022 for the Chinese Patent Application No. 201780069184.9, consisting of 2 pp.
English Translation of Office Action dated Mar. 3, 2022 for the Chinese Patent Application No. 201780069184.9, consisting of 18 pp.

* cited by examiner

PHYTASE PRODUCTION AND METHODS OF USING THE SAME

CROSS REFERENCE TO RELATED APPLICATIONS

This application is a 35 U.S.C. § 371 national phase application of PCT/US2017/59903, which was filed Nov. 3, 2017, and claims the benefit of U.S. Provisional Application No. 62/419,136, which was filed Nov. 8, 2016 and is incorporated herein by reference as if fully set forth.

The sequence listing electronically filed with this application titled "Sequence Listing," which was created on Oct. 26, 2017 and had a size of 828,602 bytes is incorporated by reference herein as if fully set forth. The Substitute Sequence listing titled "Substitute Sequence Listing" filed Jun. 9, 2020, having a file size of 829,067 bytes, and created Jun. 9, 2020 is incorporated herein by reference as if fully set forth.

FIELD

The disclosure relates to transgenic maize plants engineered to express phytases, the nucleic acids encoding the same, as well as methods of making and identifying the transgenic maize plants, and producing and utilizing animal feed. The disclosure also relates to feed additives that include phytases. The disclosure relates to genes encoding phytase forms that have been modified to improve performance as components of feed for monogastric and ruminant animals. The disclosure relates to intragenic expression of plant phytases in maize plants.

BACKGROUND

Phytases are enzymes that promote the release of inorganic phosphate from phytic acid (inositol hexakisphosphate). Phytic acid, or its deprotonated form, phytate, is common in many animal feed components such as grains and legumes, and can represent a significant portion of the total phosphate content in these feeds. However, many livestock cannot efficiently digest phytic acid and are therefore unable to absorb the phosphate. As a result, other forms of phosphate, such as rock phosphate or calcium phosphate, must be added to animal diets to provide this critical nutrient. Furthermore, phytic acid acts as an antinutrient in the diet, binding to proteins, intercalating with starch and other carbohydrates, and chelating minerals such as iron, calcium and magnesium, which prevents their absorption. Undigested phytic acid and excess inorganic phosphate can be excreted in the feces, which can act as a significant source of phosphate pollution in agricultural run-off. Inclusion of phytases in animal diets can alleviate the need to add inorganic phosphate, increasing the absorption of phosphate, proteins and minerals by the animal, and decreasing phosphate pollution from agricultural run-offs. Similarly, adding high doses of phytase onto a phosphate adequate diet can increase livestock growth and performance relative to the same diet with lower concentrations of phytase.

SUMMARY

In an aspect, the invention relates to a maize plant or part thereof comprising one or more synthetic nucleic acids. The one or more synthetic nucleic acids have a sequence with at least 90%, at least 95% or at least 99% identity to a sequence selected from the group consisting of: SEQ ID NOS: 11, 13, 15, 17, 19, 25, and 27, or a complement thereof, or the one or more synthetic nucleic acids encode a phytase comprising an amino acid sequence with at least 90%, at least 95% or at least 99% identity to a sequence selected from the group consisting of SEQ ID NOS: 12, 14, 16, 18, 20, 26, and 28.

In an aspect, the invention relates to a maize plant or part thereof comprising one or more synthetic polynucleotides selected from the group consisting of SEQ ID NOS: 42, 43, 125, 154, 156, 157, 158, 159, and 175.

In an aspect, the invention relates to a progeny of any one the maize plants described herein.

In an aspect, the invention relates to an animal feedstock comprising any one of the maize plants or parts thereof described herein or the progeny thereof.

In an aspect, the invention relates to a method of producing an animal feedstock. The method comprises mixing any one of the maize plants or parts thereof described herein, or the progeny thereof with plant material.

In an aspect, the invention relates to a method of promoting the release of inorganic phosphate from a phytic acid or phytate in an animal. The method comprises feeding an animal with an animal feedstock comprising any one of the maize plant or parts thereof described herein, or the progeny thereof.

In an aspect, the invention relates to a method of promoting the release of minerals, amino acids, and energy from a high phytase-containing diet in an animal. The method comprises feeding an animal with an animal feedstock comprising any one of the maize plant or parts thereof described herein, or the progeny thereof, and high, adequate, or deficient amounts of dietary phosphate.

In an aspect, the invention relates to a kit for identifying event PY15, PY53, PY203, PY209, PY1053, or PY1203 in a sample. The kit comprises a first primer and a second primer. The first and the second primers are capable of amplifying a synthetic polynucleotide selected from the group consisting of SEQ ID NOS: 126, 128, 130, 131, 133, 135, 136, and 176-184.

In an aspect, the invention relates to a kit for identifying event PY15, PY53, PY203, PY209, PY1053, or PY1203 in a sample. The kit comprises a probe capable of hybridizing to a synthetic polynucleotide comprising a sequence of one of SEQ ID NOS: 42, 43, 125, 154, 156, 157, 158, 159, and 175 under conditions of high stringency.

In an aspect, the invention relates to a method of identifying event PY15, PY53, PY203, PY209, PY1053, or PY1203 in a sample. The method comprises contacting a sample with a first primer and a second primer. The method also comprises amplifying a synthetic polynucleotide comprising a PY15, PY53, PY203, PY209, PY1053, or PY1203 specific region.

In an aspect, the invention relates to a method of identifying event PY15, PY53, PY203, PY209, PY1053, or PY1203 in a sample. The method comprises contacting a sample with at least one nucleic acid probe that hybridizes to a PY15, PY53, PY20-3, PY209, PY1053, or PY1203 specific region under conditions of high stringency. The method also includes detecting hybridization of the at least one nucleic acid probe to the PY15, PY53, PY203, PY209, PY1053, or PY1203 specific region.

In an aspect, the invention relates to a method of producing an animal meat. The method comprises feeding an animal with an animal feedstock comprising any one of the maize plants or parts thereof described herein, or any one of the progeny of the maize plants described herein.

In an aspect, the invention relates to a method of reducing the ratio of intake of an animal feed per weight of the meat in an animal. The method comprises feeding an animal with any one of the animal feedstocks comprising a phytase described herein.

BRIEF DESCRIPTION OF THE DRAWINGS

The following detailed description of preferred embodiments of the present invention will be better understood when read in conjunction with the appended drawings. For the purpose of illustrating the invention, there are shown in the drawings particular embodiments. It is understood, however, that the invention is not limited to the precise arrangements and instrumentalities shown. In the drawings.

DETAILED DESCRIPTION OF EMBODIMENTS

Figure 1:
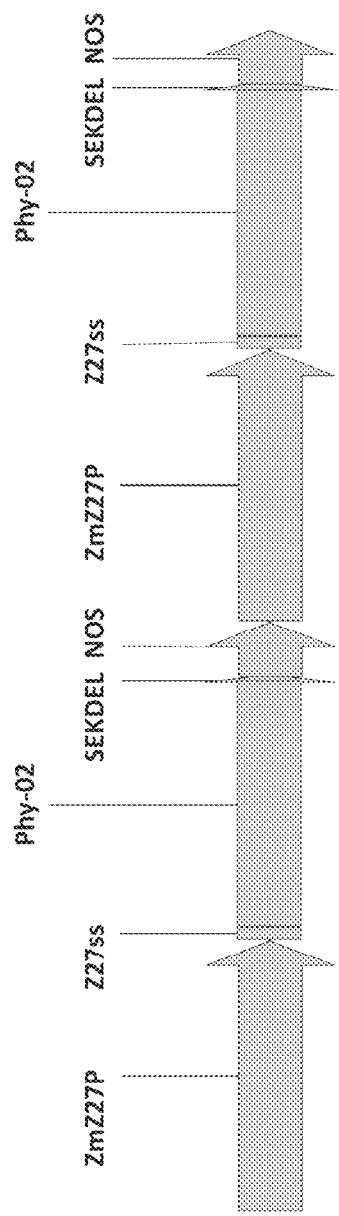
FIG. 1 illustrates tandem expression cassettes for Phy02 in the expression vector pAG4281.

The words "a" and "one," as used in the claims and in the corresponding portions of the specification, are defined as including one or more of the referenced item unless specifically stated otherwise. This terminology includes the words above specifically mentioned, derivatives thereof, and words of similar import. The phrase "at least one" followed by a list of two or more items, such as "A, B, or C," means any individual one of A, B or C as well as any combination thereof.

Certain terminology is used in the following description for convenience only and is not limiting.

"Synthetic nucleic acid sequence," "synthetic polynucleotide," "synthetic oligonucleotide," "synthetic DNA," or "synthetic RNA" as used herein refers to a nucleic acid sequence, a polynucleotide, an oligonucleotide, DNA, or RNA that differs from one found in nature by having a different sequence than one found in nature or a chemical modification not found in nature. The definition of synthetic nucleic acid includes but is not limited to a DNA sequence created using biotechnology tools. Such tools include but are not limited to recombinant DNA technology, chemical synthesis, or directed use of nucleases (so called "genome editing" or "gene optimizing" technologies).

"Synthetic protein," "synthetic polypeptide," "synthetic oligopeptide," or "synthetic peptide" as used herein refers to a protein, polypeptide, oligopeptide or peptide that was made through a synthetic process. The synthetic process includes but is not limited to chemical synthesis or recombinant technology.

As used herein, "variant" refers to a molecule that retains a biological activity that is the same or substantially similar to that of the original sequence. The variant may be from the same or different species or be a synthetic sequence based on a natural or prior molecule.

As used herein, "alignment" refers to a plurality of nucleic acid or amino acid sequences aligned lengthwise for visual identification of commonly shared nucleotides or amino acids. The percentage of commonly shared nucleotides or amino acid is related to homology or identity between sequences An alignment may be determined by used to identify conserved domains and relatedness between the sequences. An alignment may be determined by computer programs such as CLUSTAL O (1.2.1) (Sievers et al. (2011) Molecular Systems Biology 7: 539 doi: 10. 1038/msb. 2011.75).

In an embodiment, a synthetic nucleic acid encoding a phytase is provided. The synthetic nucleic acids may include a sequence with at least 70, 72, 75, 80, 85, 90, 91, 92, 93, 94, 95, 96, 97, 98, 99 or 100% identity to a sequence selected from the group consisting of: SEQ ID NO: 11 [PAPhy_b1], SEQ ID NO: 13 [PAPhy_b2], SEQ ID NO: 15 [Phy-02], SEQ ID NO: 17 [Phy-02opt], SEQ ID NO: 19 [Phy-03], SEQ ID NO: 21 [PhyNov9X], SEQ ID NO: 23 [PhyQB], SEQ ID NO: 25 [ZmPhy1], and SEQ ID NO: 27 [ZmPhy2], or a complement thereof.

In an embodiment, the synthetic nucleic acid may encode a phytase comprising an amino acid sequence with at least 70, 72, 75, 80, 85, 90, 91, 92, 93, 94, 95, 96, 97, 98, 99 or 100% identity to a reference sequence selected from the group consisting of: SEQ ID NO: 12 [PAPhy_b1], SEQ ID NO: 14 [PAPhy_b2], SEQ ID NO: 16 [Phy-02], SEQ ID NO: 18 [Phy-02opt], SEQ ID NO: 20 [Phy-03], SEQ ID NO: 22 [PhyNov9X], SEQ ID NO: 24 [PhyQB], SEQ ID NO: 26 [ZmPhy1], and SEQ ID NO: 28 [ZmPhy2] is provided. As used herein, "phytase" is an enzyme capable of catalyzing the hydrolysis of phytic acid. The phytase may be modified for improved thermal stability. The thermally stable phytase may have activity when heated to a temperature of 60° C. to 90° C.

A phytase modified for thermal stability may be produced by standard molecular biological techniques and then screened. The phytase may be subjected to mutation and then screened for thermal stability. Screening systems that can be utilized may include lambda phage, yeast, or other expression systems that allow production of the protein and/or testing of its physical and/or functional characteristics. From a population of modified proteins, candidates may be isolated and may be further analyzed. Further analysis may include DNA sequencing, functional assays, structural assays, enzyme activity assays, monitoring changes in gastric stability or lability, and monitoring changes in thermal stability, or structure in response to elevated temperature conditions.

The phytase may be modified for gastric lability. A gastric labile phytase may be a phytase that completely degrades in stimulated gastric fluid (SGF) in a time period that is less than 45 minutes. The complete degradation of the phytase may occur in a time period from 45 minutes to 40 minutes, from 40 minutes to 35 minutes, from 35 minutes to 30 minutes, from 30 minutes to 25 minutes, from 25 minutes to 20 minutes, from 20 minutes to 15 minutes, from 15 minutes to 10 minutes, from 10 minutes to 8 minutes, from 8 minutes to 6 minutes, from 6 minutes to 4 minutes, from 4 minutes to 2 minutes, or in less than 2 minutes (end points inclusive) of the SFG treatment. The time period for degradation may be in a range between any two integer value between 0 minutes and 45 minutes. The complete degradation of the phytase in SGF may occur in 10 minutes. The gastric lability of the phytase may be determined by a standardized assay for sensitivity to simulated gastric fluid (Thomas et al., 2004) as described herein in Example 4.

An embodiment provides a composition comprising, consisting essentially of, or consisting of one or more phytase. The composition may be but is not limited to a transgenic plant including the one or more phytases, an animal feedstock or animal feed additive including the one or more phytases or an enzyme mixture including the one or more phytases. The transgenic plant may be a maize plant, or part of the maize plant. The transgenic plant may be a progeny of any transgenic maize plants described herein. A phytase in the composition may be encoded by any one of the synthetic nucleic acids described herein.

Determining percent identity of two amino acid sequences or two nucleic acid sequences may include aligning and comparing the amino acid residues or nucleotides at corresponding positions in the two sequences. If all positions in two sequences are occupied by identical amino acid residues or nucleotides then the sequences are said to be 100% identical. Percent identity can be measured by the Smith Waterman algorithm (Smith T F, Waterman M S 1981 "Identification of Common Molecular Subsequences," *Journal of Molecular Biology* 147: 195-197, which is incorporated by reference in its entirety as if fully set forth).

In an embodiment, synthetic nucleic acids, polynucleotides, or oligonucleotides are provided having a portion of the sequence as set forth in any one of the nucleic acids listed herein or the complement thereof. These isolated nucleic acids, polynucleotides, or oligonucleotides are not limited to but may have a length in the range from 10 to full length, 10 to 1590, 10 to 1500, 10 to 1400, 10 to 1300, 10 to 1200, 10 to 1100, 10 to 1000, 10 to 900, 10 to 800, 10 to 600, 10 to 500, 10 to 400, 10 to 300, 10 to 200, 10 to 100, 10 to 90, 10 to 80, 10 to 70, 10 to 60, 10 to 50, 10 to 40, 10 to 35, 10 to 30, 10 to 25, 10 to 20, 10 to 15, or 20 to 30 nucleotides or 10, 15, 20 or 25 nucleotides. A synthetic nucleic acid, polynucleotide, or oligonucleotide having a length within one of the above ranges may have any specific length within the range recited, endpoints inclusive. The recited length of nucleotides may start at any single position within a reference sequence (i.e., any one of the nucleic acids herein) where enough nucleotides follow the single position to accommodate the recited length. The recited length may be full length of a sequence, or the complement thereof.

An embodiment comprises a synthetic nucleic acid, polynucleotide, or oligonucleotide comprising, consisting essentially of, or consisting of a sequence that has at least 70, 72, 75, 80, 85, 90, 91, 92, 93, 94, 95, 96, 97, 98, 99, or 100% identity along its length to a contiguous portion of a polynucleotide having any one of the sequences set forth herein or the complements thereof. The contiguous portion may be any length up to the entire length of a sequence set forth herein, or the complement thereof.

In an embodiment, a hybridization probe or primer is 85 to 100%, 90 to 100%, 91 to 100%, 92 to 100%, 93 to 100%, 94 to 100%, 95 to 100%, 96 to 100%, 97 to 100%, 98 to 100%, 99 to 100%, or 100% complementary to a nucleic acid with the same length as the probe or primer and having a sequence chosen from a length of nucleotides corresponding to the probe or primer length within a portion of a sequence as set forth in any one of the nucleic acids listed herein. In an embodiment, a hybridization probe or primer hybridizes along its length to a corresponding length of a nucleic acid having the sequence as set forth in any one of the nucleic acids listed herein. In an embodiment, the hybridization conditions are low stringency. In an embodiment, the hybridization conditions are moderate stringency. In an embodiment, the hybridization conditions are high stringency.

An embodiment provides a composition comprising, consisting essentially of, or consisting of an individual phytase or a combination of two or more phytases herein. An embodiment provides a composition comprising, consisting essentially of, or consisting of an individual phytase expression cassette or a combination of two or more phytase expression cassettes herein. An embodiment provides a composition comprising, consisting essentially of, or consisting of an individual gastric labile phytase or a combination of phytases in which at least one phytase is gastric labile.

In an embodiment, a phytase of the composition may be a variant. Variants may include conservative amino acid substitutions: i.e., substitutions with amino acids having similar properties. Conservative substitutions may be a polar for polar amino acid (Glycine (G, Gly), Serine (S, Ser), Threonine (T, Thr), Tyrosine (Y, Tyr), Cysteine (C, Cys), Asparagine (N, Asn) and Glutamine (Q, Gln)); a non-polar for non-polar amino acid (Alanine (A, Ala), Valine (V, Val), Thyptophan (W, Trp), Leucine (L, Leu), Proline (P, Pro), Methionine (M, Met), Phenilalanine (F, Phe)); acidic for acidic amino acid Aspartic acid (D, Asp), Glutamic acid (E, Glu)); basic for basic amino acid (Arginine (R, Arg), Histidine (H, His), Lysine (K, Lys)); charged for charged amino acids (Aspartic acid (D, Asp), Glutamic acid (E, Glu), Histidine (H, His), Lysine (K, Lys) and Arginine (R, Arg)); and a hydrophobic for hydrophobic amino acid (Alanine (A, Ala), Leucine (L, Leu), Isoleucine (I, Ile), Valine (V, Val), Proline (P, Pro), Phenylalanine (F, Phe), Tryptophan (W, Trp) and Methionine (M, Met)). Conservative nucleotide substitutions may be made in a nucleic acid sequence by substituting a codon for an amino acid with a different codon for the same amino acid. Variants may include non-conservative substitutions. A variant may have 40% phytase activity in comparison to the unchanged phytase. A variant may have at least 40%, 45%, 50%, 55%, 60%, 65%, 70%, 75%, 80%, 85%, 90%, 91%, 92%, 93%, 94%, 95%, 96%, 97%, 98%, 99%, or 100% activity, or an integer between any of the two values herein, in comparison to the unchanged phytase. The phytase activity may be determined by the Phytase Assay from Seed described in Example 2 herein.

In an embodiment, the one or more proteins having less than 100% identity to its corresponding amino acid sequence of SEQ ID NO: 12 [PAPhy_b1], SEQ ID NO: 14 [PAPhy_b2], SEQ ID NO: 16 [Phy-02], SEQ ID NO: 18 [Phy-02opt], SEQ ID NO: 20 [Phy-03], SEQ ID NO: 22 [PhyNov9X], SEQ ID NO: 24 [PhyQB], SEQ ID NO: 26 [ZmPhy1], or SEQ ID NO: 28 [ZmPhy2] is a variant of the referenced poein or amino acid. In an embodiment, an isolated protein, polypeptide, oligopeptide, or peptide having a sequence with at least 70, 75, 80, 85, 90, 91, 92, 93, 94, 95, 96, 97, 98, 99, or 100% identity to a protein having the sequence of any one of SEQ ID NO: 12 [PAPhy_b1], SEQ ID NO: 14 [PAPhy_b2], SEQ ID NO: 16 [Phy-02], SEQ ID NO: 18 [Phy-02opt], SEQ ID NO: 20 [Phy-03], SEQ ID NO: 22 [PhyNov9X], SEQ ID NO: 24 [PhyQB], SEQ ID NO: 26 [ZmPhy1], and SEQ ID NO: 28 [ZmPhy2] along 10 to 50, 10 to 100, 10 to 150, 10 to 300, 10 to 400, 10 to 500, 10 to 600, or 10 to all amino acids of a protein having the sequence of any of one any one of SEQ ID NO: 12 [PAPhy_b1], SEQ ID NO: 14 [PAPhy_b2], SEQ ID NO: 16 [Phy-02], SEQ ID NO: 18 [Phy-02opt], SEQ ID NO: 20 [Phy-03], SEQ ID NO: 22 [PhyNov9X], SEQ ID NO: 24 [PhyQB], SEQ ID NO: 26 [ZmPhy1], and SEQ ID NO: 28 [ZmPhy2] is provided. This list of sequence lengths encompasses every full length protein in SEQ ID NO: 12 [PAPhy_b1], SEQ ID NO: 14 [PAPhy_b2], SEQ ID NO: 16 [Phy-02], SEQ ID NO: 89 [Phy-02opt], SEQ ID NO: 20 [Phy-03], SEQ ID NO: 22 [PhyNov9X], SEQ ID NO: 24 [PhyQB], SEQ ID NO: 26 [ZmPhy1], and SEQ ID NO: 28 [ZmPhy2] and every smaller length within the list, even for proteins that do not include over 530 amino acids. For example, the lengths of 10 to 50, 10 to 100, 10 to 150, 10 to 300, 10 to 400, 10 to 500, and 10 to all amino acids would apply to a sequence with 500 amino acids. A range of amino acid sequence lengths recited herein includes every length of amino sequence within the range, endpoints inclusive. The recited length of amino acids may start at any single position within a reference sequence where enough amino acids follow the single position to accommodate the recited length. The range of sequence lengths can be extended by increments of 10 to 100N amino acids, where N=an integer of ten or greater, for sequences of 1000 amino acids or larger. The fragment of the phytase may be a subsequence of the polypeptides herein that retain at least 40% activity of the phytase. The fragment may have 100, 200, 300, 310, 315, 320, 325, 330, 335, 340, 345, 350, 355, 360, 361, 362, 364, 365, 366, 367, 368, 369, 370, 371, 373, 374, 375, 376, 377, 378, 379, 380, 385, 390, 395, 400, 410, 411, 412, 413, 414, 415, 416, 417, 418, 419, 420, 425, 430, 435, 440, 445, 450, 455, 460 465, 470, 475, 480, 485, 490, 495, 500, 510, 515, 520, 521, 522, 523, 524, or 525 amino acids. The fragments may include 20, 30, 40, 50, 100, 150, 200, 300, 400, 500 or 525 contiguous amino acids. Embodiments also include nucleic acids encoding said amino acid sequences, and antibodies recognizing epitopes on said amino acid sequences.

A less than full length amino acid sequence may be selected from any portion of one of the sequences of SEQ ID NO: 12 [PAPhy_b1], SEQ ID NO: 14 [PAPhy_b2], SEQ ID NO: 16 [Phy-02], SEQ ID NO: 18 [Phy-02opt], SEQ ID NO: 20 [Phy-03], SEQ ID NO: 22 [PhyNov9X], SEQ ID NO: 24 [PhyQB], SEQ ID NO: 26 [ZmPhy1], and SEQ ID NO: 28 [ZmPhy2] corresponding to the recited length of amino acids. A less than full length amino acid sequence may be selected from a portion of any one of SEQ ID NO: 12 [PAPhy_b1], SEQ ID NO: 14 [PAPhy_b2], SEQ ID NO: 16 [Phy-02], SEQ ID NO: 18 [Phy-02opt], SEQ ID NO: 20 [Phy-03], SEQ ID NO: 22 [PhyNov9X], SEQ ID NO: 24 [PhyQB], SEQ ID NO: 26 [ZmPhy1], and SEQ ID NO: 28 [ZmPhy2]. A less than full length amino acid sequence of SEQ ID NO: 12 may include one or more of the aspartic acid residues located at positions 178 and 205 (D178 and D205), the tyrosine residue located at position 208 (Y208), the asparagine residue located at position 262 (N262), and the histidine residues located at positions 263, 344, and 381 (H263, H344 and H381) of this sequence. A less than full length amino acid sequence of SEQ ID NO: 14 may include one or more of the aspartic acid residues located at positions 173 and 200 (D173 and D200), the tyrosine residue located at position 203 (Y203), the asparagine residue located at position 259 (N259), and the histidine residues located at positions 260, 341, and 378 (H260, H341 and H378) of this sequence. A less than full length amino acid sequence of SEQ ID NO: 26 or 28 may include one or more of the arginine residue at positions 178 and 182 (R178 and R182), and the histidine residue at position 179 (H179) of this sequence. A less than full length amino acid sequence of SEQ ID NO: 16, 20, 22 or 24 may include the RHGxRxP motif located at positions 16-22 of SEQ ID NO: 24, 18-24 of SEQ ID NO: 22, or 17-23 of SEQ ID NO: 16 or 20, wherein x refers to a variable amino acid residue. A less than full length amino acid sequence of SEQ ID NO: 24 may include one or more of the arginine residues at positions 16, 20, 92 and 267 (R16, R20, R92, and R267), the histidine residues at positions 17 and 303 (H17 and H303), the glycine residue at position 18 (G18), the proline residue at position 22 (P22), the threonine residues at positions 23 and 305 (T23 and T305), the lysine residue at position 24 (K24), the aspartic acid residues at positions 88 and 304 (D88 and D304), the serine residues at positions 212 and 215 (S212 and S215), and the methionine residue at position 216 (M21) of this sequence. A less than full length amino acid sequence of SEQ ID NO: 22 may include one or more of the arginine residues at positions 18, 22, 94 and 269 (R18, R22, R94, and R269), the histidine residues at positions 19 and 305 (H19 and H305), the glycine residue at position 20 (G20), the proline residue at position 24 (P24), the threonine residues at positions 25 and 307 (T25 and T307), the lysine residue at position 26 (K26), the aspartic acid residues at positions 90 and 306 (D90 and D306), the serine residues at positions 214 and 217 (S214 and S217), the methionine residue at position 218 (M218), and the glutamine residue at position 253 (Q253) of this sequence. A less than full length amino acid sequence of SEQ ID NOS: 16 or 22 may include one or more of the arginine residues at positions 17, 21, 93 and 268 (R17, R21, R93, and R268), the histidine residues at positions 18 and 304 (H18 and H304), the glycine residue at position 19 (G19), the proline residue at position 23 (P23), the threonine residues at positions 24 and 306 (T24 and T306), the lysine residue at position 25 (K25), the aspartic acid residues at positions 89 and 305 (D89 and D305), the serine residues at positions 213 and 216 (S213 and S216), the methionine residue at position 217 (M217), and the glutamine residue at position 253 (Q253) of this sequence. A less than full length amino acid sequence of a phytase may include cysteins that form disulfide bonds. A less than full length amino acid sequence of SEQ ID NO: 24 may include one or more pairs of the cysteine residues at positions 178 and 188 (C178 and C188); 77 and 108 (C77 and C108); 382 and 392 (C382 and C392); and 133 and 408 (C133 and C408). A less than full length amino acid sequence of SEQ ID NO: 22 may include one or more pairs of the cysteine residues at positions 76 and 205 (C76 and C205); 180 and 190 (C180 and C190); 79 and 110 (C79 and C110); 384 and 394 (C384 and C394); and 135 and 410 (C135 and C410). A less than full length amino acid sequence of SEQ ID NO: 16 may include one or more pairs of the cysteine residues at positions 78 and 109 (C78 and C109); 383 and 393 (C383 and C393); and 134 and 409 (C134 and C409). A less than full length amino acid sequence of SEQ ID NO: 20 may include one or more pairs of the cysteine residues at positions 78 and 109 (C78 and C109); 178 and 188 (C178 and C188); 383 and 393 (C383 and C393); and 134 and 409 (C134 and C409).

The fragment may include a conserved region of a phytase. The conserved region of the phytase may include amino acid residues of a sequence of SEQ ID NO: 12 [PAPhy_b1], SEQ ID NO: 14 [PAPhy_b2], SEQ ID NO: 16 [Phy-02], SEQ ID NO: 18 [Phy-02opt], SEQ ID NO: 20 [Phy-03], SEQ ID NO: 22 [PhyNov9X], SEQ ID NO: 24 [PhyQB], SEQ ID NO: 26 [ZmPhy1], and SEQ ID NO: 28 [ZmPhy2]. A "conserved region" or "conserved domain" refers to a region in heterologous nucleic acid sequences or amino acid sequences with a high degree of sequence identity between the different sequences. A "conserved domain" of a phytase refers to a domain within an amino acid sequence of a phytase family that has at least 90% identity, at least 95% identity, at least 97% identity, at least 98% identity, or at least 99% identity to a polypeptide of consecutive amino acid residues. A person of ordinary skill in the art recognizes that conserved domains of phytases may be identified as regions of identity to a specific consensus sequence. By using alignment methods known in the art, the conserved domains of phytases may be determined for phytases identified in different organisms. The conserved domains may be identified in microbial phytases or plant phytases. The conserved domains may be identified in *E. coli* phytases. The conserved domains may be identified in *Zea mays* phytases. The conserved domain for amino acid sequences of SEQ ID NO: 12 or SEQ ID NO: 14 may comprise consecutive amino acid residues 173 to 383. The conserved domain for an amino acid sequence of SEQ ID NO: 26 or 28 may comprise consecutive amino acid residues 170 to 202. The conserved domain for an amino acid sequence of SEQ ID NO: 16, 20, 22 or 28 may comprise consecutive amino acid residues 16 to 306. The conserved domain may include any fragment of a phytase that is capable of catalyzing the hydrolysis of phytic acid. The conserved domain may be gastric labile.

In an embodiment, any one or more phytases may be produced in a plant or plant tissue. The one or more phytases may be produced upon introduction into the plant genome of any one or more of synthetic nucleic acids described herein. The synthetic nucleic acid may encode a phytase enzyme or fragment thereof. The synthetic nucleic acid may be an expression cassette that directs the plant to express a phytase. The methods of introduction of synthetic nucleic acids into the plants are known in the art. The method may be transformation of the plant with a vector that includes synthetic nucleic acids encoding the one or more phytases. The one or more phytases may be isolated from the plant or plant tissue. The one or more phytases expressed in the transgenic plant herein may have activity at a pH ranging from 4.0 to 8.00. The pH may be 4.0, 5.0, 5.5, 6.0, 7.0, 7.5, or 8.0, or a pH within a range between any two of the foregoing pH values (endpoints inclusive). The one or more phytases expressed in a transgenic plant herein may have activity when exposed to a temperature in the range of 60° C. to 90° C., endpoints inclusive. The temperature may be 60° C., 65° C., 70° C., 75° C., 80° C., 85° C., 90° C., 25° C., to 30° C., 25° C. to 35° C., 25° C. to 40° C., 25° C. to 45° C., 25° C. to 50° C., 25° C. to 55° C., 25° C. to 60° C., 60° C. to 65° C., 60° C. to 70° C., 60° C. to 75° C., 60° C. to 80° C., 60° C. to 85° C., 60° C. to 90° C., or less than 90° C. The one or more phytases may be produced in any transgenic plant.

In an embodiment, a maize plant or a part thereof including a synthetic nucleic acid encoding any one or more of the phytases described herein is provided. The maize plant or a part thereof may be a transgenic maize plant or a part As used herein, the transgenic maize plant may refer to a whole transgenic maize plant or a part thereof. The part may be but is not limited to one or more of leaves, stems, flowers, buds, petals, ovaries, fruits, or seeds. The part may be callus from a transgenic plant. A transgenic maize plant may be regenerated from parts of a transgenic plant. A transgenic maize plant may be a product of sexual crossing of a first transgenic maize plant and a second transgenic maize plant or a non-transgenic maize plant where the product maize plant retains a synthetic nucleic acid introduced to the first transgenic plant. The transgenic maize plant herein is also referred to as an "event." An event is characterized by presence of the transgene comprising a synthetic nucleic acid encoding a phytase. The term "event" also refers to the genomic region of the transformed parent comprising the inserted synthetic nucleic acid sequence and the parent genomic sequences flanking the insertion. The term "event" also refers to progeny produced by crossing of the transgenic maize plant and a non-transgenic maize plant of the same genetic background. The term "line" also refers to progeny produced by crossing of the transgenic maize plant and a non-transgenic maize plant with any genetic background. After repeated crosses, the transgene and the flanking sequences of the originally transformed parent may be present in a progeny plant in the same location in the genome or on the same chromosome as in the transformed parent.

In an embodiment, a method engineering a transgenic maize plant including any one of the phytases described herein is provided. The method may include contacting at least one maize plant cell with a vector comprising a synthetic nucleic acid encoding a phytase. The synthetic nucleic acid encoding a phytase is also referred herein as a transgene. The method may include selecting a maize plant cell that includes the transgene. The method may include regenerating a transgenic maize plant that includes the transgene. The transgenic maize plant may be homozygous for the transgene. The transgenic maize plant may be heterozygous for the transgene. The heterozygous maize plant may be a hemizygous maize plant when at least one allele of the transgene encoding a phytase is missing. A heterozygous maize plant may be phenotypically indistinguishable from the wild type maize plants and may express a phytase. To produce homozygous maize plants expressing a phytase, a heterozygous transgenic maize plant may be self-crossed. Progeny may be obtained from such crosses. The progeny may include homozygous, heterozygous and wild type maize plants. The method may include analyzing the progeny for the presence of the transgene and selecting a progeny plant that includes the transgene.

In an embodiment, the method may further include crossing a heterozygous transgenic maize plant to another transgenic maize plant heterozygous for the same transgene. The method may include selecting a first progeny maize plant that is homozygous for the transgene. The method may further include crossing the transgenic maize plant to a wild type maize plant of the same genetic background. Progeny may be obtained from such crosses. The progeny may include heterozygous and wild type maize plants. The method may include selecting a first progeny plant that is heterozygous for the transgene. The method may further include selfing the first heterozygous progeny maize plant and selecting a second progeny maize plant that is homozygous for the transgene comprising a synthetic nucleic acid sequence encoding a phytase. The method may include analyzing the progeny for the presence of the transgene and selecting a progeny plant that includes the transgene. The maize plant homozygous for the transgene comprising a synthetic nucleic acid sequence encoding a phytase is also referred to herein as a homozygous event. A method of identifying the homozygous event by PCR is described herein in Example 8.

A transgenic maize plant herein may be homozygous, hemizygous, or heterozygous for the gene encoding a phytase. A transgenic maize plant may be an intragenic maize plant. As used herein, the term "intragenic plant" refers to a plant expressing a gene coding for a phytase from another plant species, from the crop plant itself, or from a sexually compatible donor plant that can be used in conventional breeding. An intragenic maize plant contains no phytase genes derived from non-plant species. The intragenic phytase gene itself may be a synthetic gene that has been optimized for expression in the host plant, but encodes a phytase enzyme that is derived from another plant species or the same plant species.

A transgenic maize plant may be a cisgenic maize plant. As used herein, the term "cisgenic plant" refers to a plant expressing a gene coding for a phytase from the same species, from the crop plant itself, or from a sexually compatible donor plant that can be used in conventional breeding.

A transgenic maize plant, intragenic or cisgenic maize plant may include more than one gene encoding a phytase. If a transgenic, intragenic or cisgenic maize plant includes more than one gene encoding a phytase integrated into the different regions of the plant genome, the undesirable genes may be segregated away during the above-described crosses.

An embodiment provides a progeny of any one of the transgenic maize plants, intragenic or cisgenic maize plants described herein.

In an embodiment, a method of increasing phytase activity in a seed is provided. The method may include crossing genetically independent transgenic or intragenic maize plants or events. As used herein, "genetically independent events" refer to transgenic or intragenic maize plants having DNA insertions in different regions of the plant genome. The method may include obtaining a progeny plant having phytase activity of at least 200 FTU/g, 1,000 FTU/g, 5,000 FTU/g, 10,000 FTU/g, 15,000 FTU/g, or more than 20,000 FTU/g.

In an embodiment, a maize plant or part thereof may comprise one or more synthetic nucleic acids comprising a sequence with at least 70, 72, 75, 80, 85, 90, 91, 92, 93, 94, 95, 96, 97, 98, 99 or 100% identity to a sequence selected from the group consisting of: SEQ ID NOS: 11, 13, 15, 17, 19, 21, 23, 25, and 27, or a complement thereof. The maize plant or part thereof may comprise one or more synthetic nucleic acids encoding a phytase comprising an amino acid sequence with at least 70, 72, 75, 80, 85, 90, 91, 92, 93, 94, 95, 96, 97, 98, 99 or 100% identity to a sequence selected from the group consisting of: SEQ ID NOS: 12, 14, 16, 18, 20, 22, 24, 26, and 28. The maize plant or part thereof may comprise the phytase comprising the amino acid sequence with at least 70, 72, 75, 80, 85, 90, 91, 92, 93, 94, 95, 96, 97, 98, 99 or 100% identity to a sequence of SEQ ID NO: 12. The maize plant or part thereof may comprise the phytase comprising a conserved domain with at least 90, 91, 92, 93, 94, 95, 96, 97, 98, 99, or 100% identity to amino acid residues 173-383 of SEQ ID NO: 12. The maize plant or part thereof may comprise the phytase comprising the amino acid sequence with at least 70, 72, 75, 80, 85, 90, 91, 92, 93, 94, 95, 96, 97, 98, 99 or 100% identity to a sequence of SEQ ID NO: 14. The maize plant or part thereof may comprise the phytase comprising a conserved domain with at least 90, 91, 92, 93, 94, 95, 96, 97, 98, 99, or 100% identity to amino acid residues 173-383 of SEQ ID NO: 14. The maize plant or part thereof may comprise the phytase comprising the amino acid sequence with at least 70, 72, 75, 80, 85, 90, 91, 92, 93, 94, 95, 96, 97, 98, 99 or 100% identity to a sequence of SEQ ID NO: 16. The maize plant or part thereof may comprise the phytase comprising a conserved domain with at least 90, 91, 92, 93, 94, 95, 96, 97, 98, 99, or 100% identity to amino acid residues 16-306 of SEQ ID NO: 16. The maize plant or part thereof may comprise the phytase comprising the amino acid sequence with at least 70, 72, 75, 80, 85, 90, 91, 92, 93, 94, 95, 96, 97, 98, 99 or 100% identity to a sequence of SEQ ID NO: 20. The maize plant or part thereof may comprise the phytase comprising a conserved domain with at least 90, 91, 92, 93, 94, 95, 96, 97, 98, 99, or 100% identity to amino acid residues 16-306 of SEQ ID NO: 20. The maize plant or part thereof may comprise the phytase comprising the amino acid sequence with at least 70, 72, 75, 80, 85, 90, 91, 92, 93, 94, 95, 96, 97, 98, 99 or 100% identity to a sequence of SEQ ID NO: 22. The maize plant or part thereof may comprise the phytase comprising a conserved domain with at least 90, 91, 92, 93, 94, 95, 96, 97, 98, 99, or 100% identity to amino acid residues 16-306 of SEQ ID NO: 22. The maize plant or part thereof may comprise the phytase comprising the amino acid sequence with at least 70, 72, 75, 80, 85, 90, 91, 92, 93, 94, 95, 96, 97, 98, 99 or 100% identity to a sequence of SEQ ID NO: 26. The maize plant or part thereof may comprise the phytase comprising a conserved domain with at least 90, 91, 92, 93, 94, 95, 96, 97, 98, 99, or 100% identity to amino acid residues 170-202 of SEQ ID NO: 26. The maize plant or part thereof may comprise the phytase comprising the amino acid sequence with at least 70, 72, 75, 80, 85, 90, 91, 92, 93, 94, 95, 96, 97, 98, 99 or 100% identity to a sequence of SEQ ID NO: 28. The maize plant or part thereof may comprise the phytase comprising a conserved domain with at least 90, 91, 92, 93, 94, 95, 96, 97, 98, 99, or 100% identity to amino acid residues 16-306 of SEQ ID NO: 28.

The maize plant or part thereof may comprise one or more synthetic nucleic acid that are included in the expression cassette. The expression cassette may include at least one regulatory element. The regulatory element may be operably connected to the one or more synthetic nucleic acids. In this context, operably linked means that the regulatory element imparts its function on the nucleic acid. The regulatory element may be selected from the group consisting of: a promoter, a signal peptide, a C-terminal extension and a terminator. For example, a regulatory element may be a promoter, and the operably linked promoter would control expression of the nucleic acid.

The expression of a synthetic nucleic acid encoding a phytase from the expression cassette may be under the control of a promoter which provides for transcription of the nucleic acid in a plant. The promoter may be a constitutive promoter or, tissue specific, or an inducible promoter. A constitutive promoter may provide transcription of the nucleic acid throughout most cells and tissues of the plant and during many stages of development but not necessarily all stages. An inducible promoter may initiate transcription of the nucleic acid sequence only when exposed to a particular chemical or environmental stimulus. A tissue specific promoter may be capable of initiating transcription in a particular plant tissue. Plant tissue may be, but is not limited to, a stem, leaves, trichomes, anthers, cob, seed, endosperm, or embryo. The constitutive promoter may be, but is not limited to the Cauliflower Mosaic Virus (CAMV) 35S promoter, the Cestrum Yellow Leaf Curling Virus promoter (CMP), the actin promoter, the maize ubiquitin promoter, the switchgrass (*Panicum*) ubiquitin promoter, or the Rubisco small subunit promoter. The tissue specific promoter may be the maize globulin promoter (ZmGlb1), the rice glutelin promoter (prGTL), the rice glutelin B4 (osGluB-4) promoter, the maize gamma zein promoter (ZmZ27), or the maize oleosin promoter (ZmOle). The promoter may include a sequence with at least 70, 72, 75, 80, 85, 90, 91, 92, 93, 94, 95, 96, 97, 98, 99 or 100% identity to a reference sequence selected from the group consisting of: SEQ ID NOS: 2-6. The promoter may provide transcription of a synthetic nucleic acid having a sequence with at least 70, 72, 75, 80, 85, 90, 91, 92, 93, 94, 95, 96, 97, 98, 99, or 100% identity to a reference sequence selected from the group consisting of SEQ ID NOS: 11, 13, 15, 18, 19, 21, 23, 25, and 27 and expression of a phytase that is capable of catalyzing the hydrolysis of phytic acid.

The signal peptide may include a sequence with at least 70, 72, 75, 80, 85, 90, 91, 92, 93, 94, 95, 96, 97, 98, 99 or 100% identity to a reference sequence selected from the group consisting of: SEQ ID NOS: 7-10 and 31.

The C-terminal extension may include a sequence with at least 70, 72, 75, 80, 85, 90, 91, 92, 93, 94, 95, 96, 97, 98, 99 or 100% identity to a sequence of SEQ ID NO: 30 or SEQ ID NO: 32.

The terminator may include a sequence with at least 70, 72, 75, 80, 85, 90, 91, 92, 93, 94, 95, 96, 97, 98, 99 or 100% identity to a reference sequence selected from the group consisting of: SEQ ID NOS: 33-35.

The maize plant or part thereof may be transformed with a vector comprising a polynucleotide sequence with at least 70, 72, 75, 80, 85, 90, 91, 92, 93, 94, 95, 96, 97, 98, 99 or 100% identity to SEQ ID NO: 36-37, 46-98, 138-149 or 181. The maize plant may be made by *Agrobacterium* mediated transformation using transformation vectors known in the art and described herein. The maize plant may be made using biolistic transformation using methods known in the art.

In an embodiment, a maize plant or part thereof may comprise one more synthetic polynucleotides of SEQ ID NO: 42, 43, 125, 154, 156, 157, 158, 159, or 175.

The maize plant or part thereof may comprise the synthetic polynucleotide of SEQ ID NOS: 42 or 43, or both. The synthetic polynucleotides of SEQ ID NOS: 42 or 43, or both, may produce a diagnostic amplicon for identifying event PY203. As used herein, event PY203 refers to a maize plant produced following transformation with the construct pAG4758. Event PY203 includes one T-DNA inserted into a region of chromosome 8 comprising a sequence of SEQ ID NO: 39, and another T-DNA inserted into region of chromosome 2 comprising a sequence of SEQ ID NO: 40.

The maize plant or part thereof may comprise a synthetic polynucleotide of SEQ ID NO: 125. The synthetic polynucleotide of SEQ ID NO: 125 may produce a diagnostic amplicon for identifying event PY15. Event PY15 refers to a maize plant produced following transformation with the construct pAG4758. Event PY15 includes three partial T-DNA sequences inserted into a region of chromosome 5 comprising a sequence of SEQ ID NO: 41.

The maize plant or part thereof may comprise a synthetic polynucleotide of SEQ ID NO: 175. The synthetic polynucleotide of SEQ ID NO: 175 may produce a diagnostic amplicon for identifying event PY53. Event PY53 refers to a maize plant produced following transformation with the construct pAG4281. Event PY53 includes three complete T-DNA sequences and one partial T-DNA sequence inserted into a region of chromosome 6.

The maize plant or part thereof may comprise a synthetic polynucleotide of SEQ ID NO: 154. The synthetic polynucleotide of SEQ ID NO: 154 may produce a diagnostic amplicon for identifying event PY209. Event PY209 refers to a maize plant produced following transformation with the construct pAG4295. Event PY209 includes a single T-DNA sequence inserted into a region of chromosome 4.

The maize plant or part thereof may comprise the synthetic polynucleotide of SEQ ID NOS: 156 or 157, or both. The synthetic polynucleotides of SEQ ID NOS: 156 or 157, or both, may produce a diagnostic amplicon for identifying event PY1053. As used herein, event PY1053 refers to a maize plant produced following transformation with the construct pAG4915.

The maize plant or part thereof may comprise the synthetic polynucleotide of SEQ ID NOS: 158 or 159, or both. The synthetic polynucleotides of SEQ ID NOS: 158 or 159, or both, may produce a diagnostic amplicon for identifying event PY1203. As used herein, event PY1203 refers to a maize plant produced following transformation with the construct pAG4916.

As used herein, "amplicon" refers to a portion of DNA that is the product of polynucleotide amplification of a target polynucleotide that is part of a nucleic acid template. The amplicon can be formed by using various amplification methods including polymerase chain reaction (PCR). To determine whether a maize plant resulting from a sexual cross contains event PY15, PY53, PY203, PY209, PY1053, or PY1203, DNA extracted from the tissue of the maize plant may be subjected to a polynucleotide amplification method using a DNA primer pair that includes a first primer derived from flanking sequence adjacent to the insertion site of inserted heterologous DNA, or T-DNA, and a second primer derived from the inserted heterologous DNA, or T-DNA, to produce an amplicon that is diagnostic for the presence of event PY15, PY53, PY203, PY209, PY1053, or PY1203 DNA. Alternatively, the second primer may be derived from the flanking sequence.

In an embodiment, the first primer and the second primer may be derived from flanking sequence on both sides of the inserted DNA so as to produce an amplicon that includes the entire insert polynucleotide of the expression construct as well as the sequence flanking the transgenic insert. The amplicon may be of a length and may have a sequence that is diagnostic for the event. The diagnostic amplicon may include a junction DNA from event PY15, PY53, PY203, PY209, PY1053, or PY1203. The amplicon may range in length from the combined length of the primer pairs plus one nucleotide base pair to any length of amplicon producible by a DNA amplification protocol. A member of a primer pair derived from the flanking sequence may be located a distance from the inserted DNA sequence, this distance can range from one nucleotide base pair up to the limits of the amplification reaction, or about twenty thousand nucleotide base pairs.

A "diagnostic amplicon" for event PY15, PY53, PY203, PY209, PY1053, or PY1203, may be produced by any method or assay which discriminates between the presence or the absence of event PY15, PY53, PY203, PY209, PY1053, or PY1203 in a biological sample.

In an embodiment, a kit for identifying event PY15, PY53, PY203, PY209, PY1053, or PY1203 in a sample is provided. As used herein, a sample may be any sample which a skilled person can use to determine the presence of a nucleic acid or nucleic acids specific to event PY15, PY53, PY203, PY209, PY1053, or PY1203. The sample may be any plant material or material comprising or derived from a plant material such as, but not limited to, food or feed products. As used herein, "plant material" refers to material which is obtained or derived from a plant or plant part. The sample may comprise a maize tissue. The sample may be an extract from the sample comprising the plant material or maize tissue. The kit may include a first primer and a second primer. The first primer and a second primer may be capable of annealing to and amplifying the target DNA by the polymerase chain reaction (PCR). The target DNA may be isolated from event PY15, PY53, PY203, PY209, PY1053, or PY1203. The first primer and a second primer may be capable of amplifying a synthetic polynucleotide of SEQ ID NOS: 126, 128, 130, 131, 133, 135, 136, 176, 177, 178, 179 or 180.

In an embodiment, a kit for identifying event PY15 in a sample is provided. The kit may include a first primer and a second primer. The first primer and a second primer may be capable of annealing to and amplifying the target DNA by the polymerase chain reaction (PCR). The target DNA may be isolated from event PY15. The first primer and a second primer may be capable of amplifying a synthetic polynucleotide of SEQ ID NO: 126. The kit may include a probe capable of hybridizing to a synthetic polynucleotide comprising a sequence of SEQ ID NO: 125 under conditions of high stringency. As used herein, the term "probe" refers to a synthetic polynucleotide complementary to a strand of a target DNA. The target DNA may be isolated from event PY15. The probe may be attached to a reporter molecule. The reporter molecule may be but is not limited to a radioisotope, luminescent agent, or enzyme. The probe may be used for identifying of the DNA originating from event PY15.

In an embodiment, a kit for identifying event PY203 in a sample is provided. The kit may include a first primer and a second primer. The first primer and a second primer may be capable of annealing to and amplifying the target DNA by the polymerase chain reaction (PCR). The target DNA may be isolated from event PY203. The first primer and a second primer may be capable of amplifying a synthetic polynucleotide selected from SEQ ID NOS: 128, 130, 131, and 133. The kit may include a probe capable of hybridizing to a synthetic polynucleotide comprising a sequence of SEQ ID NO: 42 or 43 under conditions of high stringency. The probe may be used for identifying of the DNA originating from event PY203.

In an embodiment, a kit for identifying event PY53 in a sample is provided. The kit may include a first primer and a second primer. The first primer and a second primer may be capable of annealing to and amplifying the target DNA by the polymerase chain reaction (PCR). The target DNA may be isolated from event PY53. The first primer and a second primer may be capable of amplifying a synthetic polynucleotide selected from SEQ ID NO: 135 or 136. The kit may include a probe capable of hybridizing to a synthetic polynucleotide comprising a sequence of SEQ ID NO: 175 under conditions of high stringency. The probe may be used for identifying of the DNA originating from event PY53.

In an embodiment, a kit for identifying event PY209 in a sample is provided. The kit may include a first primer and a second primer. The first primer and a second primer may be capable of annealing to and amplifying the target DNA by the polymerase chain reaction (PCR). The target DNA may be isolated from event PY209. The first primer and a second primer may be capable of amplifying a synthetic polynucleotide selected from SEQ ID NO: 176. The kit may include a probe capable of hybridizing to a synthetic polynucleotide comprising a sequence of SEQ ID NO: 154 under conditions of high stringency. The probe may be used for identifying of the DNA originating from event PY209.

In an embodiment, a kit for identifying event PY1053 in a sample is provided. The kit may include a first primer and a second primer. The first primer and a second primer may be capable of annealing to and amplifying the target DNA by the polymerase chain reaction (PCR). The target DNA may be isolated from event PY1053. The first primer and a second primer may be capable of amplifying a synthetic polynucleotide selected from SEQ ID NO: 177 and 178. The kit may include a probe capable of hybridizing to a synthetic polynucleotide comprising a sequence of SEQ ID NO: 156 or 157 under conditions of high stringency. The probe may be used for identifying of the DNA originating from event PY1053.

In an embodiment, a kit for identifying event PY1203 in a sample is provided. The kit may include a first primer and a second primer. The first primer and a second primer may be capable of annealing to and amplifying the target DNA by the polymerase chain reaction (PCR). The target DNA may be isolated from event PY1203. The first primer and a second primer may be capable of amplifying a synthetic polynucleotide selected from SEQ ID NO: 179 and 180. The kit may include a probe capable of hybridizing to a synthetic polynucleotide comprising a sequence of SEQ ID NO: 158 or 159 under conditions of high stringency. The probe may be used for identifying of the DNA originating from event PY1203.

In an embodiment, synthetic nucleic acids are provided having a sequence as set forth in any one of the nucleic acids listed herein or the complement thereof. In an embodiment, isolated nucleic acids having a sequence that hybridizes to a nucleic acid having the sequence of any nucleic acid listed herein or the complement thereof are provided. In an embodiment, the hybridization conditions are low stringency conditions. In an embodiment, the hybridization conditions are moderate stringency conditions. In an embodiment, the hybridization conditions are high stringency conditions. The hybridization may be along the length of the synthetic nucleic acid. Examples of hybridization protocols and methods for optimization of hybridization protocols are described in the following books: Molecular Cloning, T. Maniatis, E. F. Fritsch, and J. Sambrook, Cold Spring Harbor Laboratory, 1982; and, Current Protocols in Molecular Biology, F. M. Ausubel, R. Brent, R. E. Kingston, D. D. Moore, J. G. Seidman, J. A. Smith, K. Struhl, Volume 1, John Wiley & Sons, 2000 (standard protocol) and Amersham Gene Images AlkPhos Direct Labeling and Detection System (GE Healthcare UK, Ltd), which are incorporated by reference in their entirety as if fully set forth.

In AlkPhos Direct Labeling and Detection System, moderate conditions may be as follows: membranes loaded with DNA samples are prehybridized for at least 15 minutes at 55° C. in the hybridization buffer (12% (w/v) urea, 0.5M NaCl, 4% (w/v) blocking reagent). The labeled probe is added to the same solution and hybridization is carried overnight at 55° C. The membranes are washed for 10 minutes at 55° C. in the primary wash solution (2M urea, 0.1% (W/v) SDS, 50 mM of 0.5M Na phosphate pH 7.0, 150 mM NaCl, 1 mM of 1.0 M Mg $Cl_2$ and 0.2% (w/v) of blocking reagent). The washing procedure is repeated. The membranes are placed in a clean container and washed for 5 minutes in a secondary buffer (1M Tris base, and 2M NaCl). The washing in the secondary solution is performed two more time. Chemoluminescence was detected using CDP-STAR® substrate for alkaline phosphatase. Low stringency refers to hybridization conditions at low temperatures, for example, between 37° C. and 60° C. High stringency refers to hybridization conditions at high temperatures, for example, over 68° C.

In the standard protocol, moderate conditions may be as follows: filters loaded with DNA samples are pretreated for 2-4 hours at 68° C. in a solution containing 6× citrate buffered saline (SSC; Amresco, Inc., Solon, Ohio), 0.5% sodium dodecyl sulfate (SDS; Amresco, Inc., Solon, Ohio), 5×Denhardt's solution (Amresco, Inc., Solon, Ohio), and denatured salmon sperm (Invitrogen Life Technologies, Inc. Carlsbad, Calif.). Hybridization is carried in the same solution with the following modifications: 0.01 M EDTA (Amresco, Inc., Solon, Ohio), 100 µg/ml salmon sperm DNA, and 5-20×10$^6$ cpm $^{32}$P-labeled or fluorescently labeled probes. Filters are incubated in hybridization mixture for 16-20 hours and then washed for 15 minutes in a solution containing 2×SSC and 0.1% SDS. The wash solution is replaced for a second wash with a solution containing 0.1×SSC and 0.5% SDS and incubated an additional 2 hours at 20° C. to 29° C. below Tm (melting temperature in ° C.). Tm=81.5+16.61 $Log_{10}$([Na$^+$]/(1.0+0.7[Na$^+$]))+0.41(%[G+C])−(500/n)−P−F. [Na+]=Molar concentration of sodium ions. %[G+C]=percent of G+C bases in DNA sequence. N=length of DNA sequence in bases. P=a temperature correction for % mismatched base pairs (~1° C. per 1% mismatch). F=correction for formamide concentration (=0.63° C. per 1% formamide). Filters are exposed for development in an imager or by autoradiography. Low stringency conditions refers to hybridization conditions at low temperatures, for example, between 37° C. and 60° C., and the second wash with higher [Na$^+$] (up to 0.825M) and at a temperature 40° C. to 48° C. below Tm. High stringency refers to hybridization conditions at high temperatures, for example, over 68° C., and the second wash with [Na+] =0.0165 to 0.0330M at a temperature 5° C. to 10° C. below Tm. In an embodiment, synthetic nucleic acids having a sequence that has at least 75, 80, 85, 90, 91, 92, 93, 94, 95, 96, 97, 98, 99 or 100% identity along its length to a contiguous portion of a nucleic acid having any one of the sequences set forth herein or the complements thereof are provided. The contiguous portion may be the entire length of a sequence set forth herein or the complement thereof.

In an embodiment, a method of identifying event PY15, PY53, PY203, PY209, PY1053, or PY1203 in a sample is provided. The method may include contacting a sample with a first primer and a second primer. The method may include amplifying a synthetic polynucleotide specific to the PY15, PY53, PY203, PY209, PY1053, or PY1203 region.

In an embodiment, a method of identifying event PY15 in a sample is provided. The method may include contacting a sample with a first primer and a second primer. The first primer may be a sequence of SEQ ID NO: 100. The second primer may be a sequence of SEQ ID NOS: 99. The method may include amplifying a synthetic polynucleotide specific to the PY15 region. The synthetic polynucleotide specific to the PY15 region may be a synthetic polynucleotide of SEQ ID NO: 126. The synthetic polynucleotide may be a portion of the synthetic polynucleotide of SEQ ID NO: 126. The method may include amplifying the synthetic polynucleotide of SEQ ID NO: 126, or a portion thereof.

In an embodiment, a method of identifying event PY53 in a sample is provided. The method may include contacting a sample with a first primer and a second primer. The first primer may be a sequence selected from the group consisting of SEQ ID NOS: 120 and 121. The second primer may be a sequence of SEQ ID NO: 119. The method may include amplifying a synthetic polynucleotide specific to the PY53 region. The synthetic polynucleotide specific to the PY53 region may be a synthetic polynucleotide of SEQ ID NO: 135 or 136. The synthetic polynucleotide may be a portion of the synthetic polynucleotide of SEQ ID NO: 135 or 136. The method may include amplifying the synthetic polynucleotide of SEQ ID NOS: 135 or 136, or a portion thereof. The first primer may be a sequence of SEQ ID NO: 121 and the second primer may be a sequence of SEQ ID NO: 119, and the method may include amplifying the synthetic polynucleotide with a sequence of SEQ ID NO: 135. The first primer may be a sequence of SEQ ID NO: 120 and the second primer may be a sequence of SEQ ID NO: 119, and the method may include amplifying the synthetic polynucleotide with a sequence of SEQ ID NO: 136.

In an embodiment, a method of identifying event PY203 in a sample is provided. The method may include contacting a sample with a first primer and a second primer. The first primer may be a sequence selected from the group consisting of SEQ ID NOS: 105, 107 and 110. The second primer may be a sequence selected from the group consisting of SEQ ID NOS: 104, and 109. The method may include amplifying a synthetic polynucleotide specific to the PY203 region. The synthetic polynucleotide specific to the PY203 region may be a synthetic polynucleotide of SEQ ID NO: 128, 130, 131, or 133. The synthetic polynucleotide may be a portion of the synthetic polynucleotide of SEQ ID NO: 128, 130, 131, or 133. The method may include amplifying the synthetic polynucleotide of SEQ ID NOS: 128, 130, 131, or 133, or a portion thereof. The first primer may be a sequence of SEQ ID NO: 105 and the second primer may be a sequence of SEQ ID NO: 104, and the method may include amplifying the synthetic polynucleotide with a sequence of SEQ ID NO: 128. The first primer may be a sequence of SEQ ID NO: 105 and the second primer may be a sequence of SEQ ID NO: 109, and the method may include amplifying the synthetic polynucleotide with a sequence of SEQ ID NO: 130. The first primer may be a sequence of SEQ ID NO: 107 and the second primer may be a sequence of SEQ ID NO: 104, and the method may include amplifying the synthetic polynucleotide with a sequence of SEQ ID NO: 131. The first primer may be a sequence of SEQ ID NO: 110 and the second primer may be a sequence of SEQ ID NO: 109, and the method may include amplifying the synthetic polynucleotide with a sequence of SEQ ID NO: 133.

In an embodiment, a method of identifying event PY209 in a sample is provided. The method may include contacting a sample with a first primer and a second primer. The first primer may be a sequence of SEQ ID NO: 161. The second primer may be a sequence of SEQ ID NOS: 164. The method may include amplifying a synthetic polynucleotide specific to the PY209 region. The synthetic polynucleotide specific to the PY209 region may be a synthetic polynucleotide of SEQ ID NO: 176. The synthetic polynucleotide may be a portion of the synthetic polynucleotide of SEQ ID NO: 176. The method may include amplifying the synthetic polynucleotide of SEQ ID NO: 176, or a portion thereof.

In an embodiment, a method of identifying event PY1053 in a sample is provided. The method may include contacting a sample with a first primer and a second primer. The first primer may be a sequence of SEQ ID NO: 161. The second primer may be a sequence of SEQ ID NOS: 173, or 174. The method may include amplifying a synthetic polynucleotide specific to the PY1053 region. The synthetic polynucleotide specific to the PY1053 region may be a synthetic polynucleotide of SEQ ID NO: 177 or 178. The synthetic polynucleotide may be a portion of the synthetic polynucleotide of SEQ ID NO: 177 or 178. The method may include amplifying the synthetic polynucleotide of SEQ ID NO: 177, or 178, or a portion thereof. The first primer may be a sequence of SEQ ID NO: 161 and the second primer may be a sequence of SEQ ID NO: 173, and the method may include amplifying the synthetic polynucleotide with a sequence of SEQ ID NO: 177. The first primer may be a sequence of SEQ ID NO: 161 and the second primer may be a sequence of SEQ ID NO: 174, and the method may include amplifying the synthetic polynucleotide with a sequence of SEQ ID NO: 178.

In an embodiment, a method of identifying event PY1203 in a sample is provided. The method may include contacting a sample with a first primer and a second primer. The first primer may be a sequence of SEQ ID NO: 172. The second primer may be a sequence of SEQ ID NO: 170 or 171. The method may include amplifying a synthetic polynucleotide specific to the PY1203 region. The synthetic polynucleotide specific to the PY1203 region may be a synthetic polynucleotide of SEQ ID NO: 179 or 180. The synthetic polynucleotide may be a portion of the synthetic polynucleotide of SEQ ID NO: 179 or 180. The method may include amplifying the synthetic polynucleotide of SEQ ID NO: 179, or 180, or a portion thereof. The first primer may be a sequence of SEQ ID NO: 172 and the second primer may be a sequence of SEQ ID NO: 171, and the method may include amplifying the synthetic polynucleotide with a sequence of SEQ ID NO: 179. The first primer may be a sequence of SEQ ID NO: 172 and the second primer may be a sequence of SEQ ID NO: 170, and the method may include amplifying the synthetic polynucleotide with a sequence of SEQ ID NO: 180.

Applicant made a deposit of at least 2500 seeds of maize event PY1203 with the ATCC, Manassas, Va. 20110-2209 U.S.A., on Jul. 9, 2021, and the deposits were assigned ATCC Deposit No. PTA-127093. These deposits will be maintained under the terms of the Budapest Treaty on the International Recognition of the Deposit of Microorganisms for the Purposes of Patent Procedure.

In an embodiment, a method of identifying event PY15 is provided. The method may include contacting a sample with at least one nucleic acid probe that hybridizes to a PY15 specific region under conditions of high stringency. The PY15 specific region may be a region including a sequence of SEQ ID NO: 126 or 149. The method may include detecting hybridization of the at least one nucleic acid probe to the PY15 specific region.

In an embodiment, a method of identifying event PY53 is provided. The method may include contacting a sample with at least one nucleic acid probe that hybridizes to a PY53 specific region under conditions of high stringency. The PY53 specific region may be a region including a sequence of SEQ ID NO: 83, 135 or 136. The method may include detecting hybridization of the at least one nucleic acid probe to the PY53 specific region.

In an embodiment, a method of identifying event PY203 is provided. The method may include contacting a sample with at least one nucleic acid probe that hybridizes to a PY203 specific region under conditions of high stringency. The PY203 specific region may be a region including a sequence of SEQ ID NO: 128, 130, 131, 133 or 149. The method may include detecting hybridization of the at least one nucleic acid probe to the PY203 specific region.

In an embodiment, a method of identifying event PY209 is provided. The method may include contacting a sample with at least one nucleic acid probe that hybridizes to a PY209 specific region under conditions of high stringency. The PY209 specific region may be a region including a sequence of SEQ ID NO: 176, 181, or 182. The method may include detecting hybridization of the at least one nucleic acid probe to the PY209 specific region.

In an embodiment, a method of identifying event PY1053 is provided. The method may include contacting a sample with at least one nucleic acid probe that hybridizes to a PY1053 specific region under conditions of high stringency. The PY1053 specific region may be a region including a sequence of SEQ ID NO: 60, 177 or 178, or 183. The method may include detecting hybridization of the at least one nucleic acid probe to the PY1053 specific region.

In an embodiment, a method of identifying event PY21203 is provided. The method may include contacting a sample with at least one nucleic acid probe that hybridizes to a PY1203 specific region under conditions of high stringency. The PY1203 specific region may be a region including a sequence of SEQ ID NO: 64, 179, 180, or 184. The method may include detecting hybridization of the at least one nucleic acid probe to the PY1203 specific region.

In an embodiment, an animal feedstock comprising any one or more of the maize plants described herein, parts of the maize plants, or the progeny thereof is provided. The term "animal feedstock" refers to any food, feed, feed composition, preparation, additive, supplement, or mixture suitable and intended for intake by animals for their nourishment and growth. The phytases included in the maize plants and in the animal feedstock may be active in the gastrointestinal or rumen environment of animals. The phytases included in the maize plants and in the animal feedstock may be gastric labile. The animal may be a monogastric animal. The animal may be a ruminant animal. The monogastric animal may be but is not limited to a chicken, a turkey, a duck, a swine, a fish, a cat, or a dog. The ruminant animal may be but is not limited to cattle, a cow, a sheep, a horse, or a goat. The phytases may be active after preparation of the animal feed. The temperature which feeds are exposed to during ensiling may be within range of 20° C. to 70° C. The ensiling temperature may be a temperature in the range from 20° C. to 30° C., from 30° C. to 40° C., from 40° C. to 50° C., from 50° C. to 60° C., or from 60° C. to 70° C. The temperature may be any temperature within the range recited, endpoints inclusive. The temperature which feeds are exposed to during pelleting may be within a range of 70° C. to 130° C. The temperature may be a temperature in the range from 70° C. to 75° C., from 75° C. to 80° C., from 80° C. to 85° C., from 85° C. to 90° C., from 90° C. to 95° C., from 95° C. to 100° C., from 100° C. to 105° C., from 105° C. to 110° C., from 110° C. to 115° C., from 115° C. to 120° C., from 120° C. to 125° C., or from 125° C. to 130° C. The temperature may be any temperature within the range recited, endpoints inclusive.

The animal feedstock may comprise phytases that have improved thermal stability and retain activity after being exposed to high temperatures during feed pelleting. The phytase with improved thermal stability may comprise, consist essentially of, or consist of an amino acid sequence with at least 70, 72, 75, 80, 85, 90, 91, 92, 93, 94, 95, 96, 97, 98, 99, or 100% identity to a reference sequence selected from the group consisting of: SEQ ID NO: 12 [PAPhy_b1], SEQ ID NO: 14 [PAPhy_b2], SEQ ID NO: 16 [Phy-02], SEQ ID NO: 18 [Phy-02opt], SEQ ID NO: 20 [Phy-03], SEQ ID NO: 22 [PhyNov9X], SEQ ID NO: 24 [PhyQB], SEQ ID NO: 26 [ZmPhy1], and SEQ ID NO: 28 [ZmPhy2]. The phytase with improved thermal stability may be any one of the phytases described herein. The phytase with improved thermal stability may be gastric labile. The phytase may be gastric stable.

In an embodiment, a phytase may be isolated from the maize plant or part thereof prior to being included into the animal feedstock.

In an embodiment, the animal feedstock may further include a feed supplement. The feed supplement may be any plant material. The plant material may be a non-transgenic plant or a transgenic plant. The plant material may include a mutant plant. The plant material may be a grain that contains starch. The plant material may be a grain that contains fiber. The plant material may be a chemically treated forage. The feed supplement may be a mineral. The mineral may be a trace mineral. The mineral may be a macro mineral. The mineral may be rock phosphate or a phosphate salt. The mineral may be calcium phosphate. The feed supplement may be at least one vitamin. The at least one vitamin may be a fat-soluble vitamin. The feed supplement may be an amino acid. The feed supplement may include one or more exogenous enzymes. The one or more exogenous enzymes may include a hydrolytic enzyme. The hydrolytic enzyme may be an enzyme classified under EC3.4 as hydrolase. The hydrolytic enzymes may be but are not limited to xylanases, mannanases, carbohydrases, proteases, peptidases, glucanases, cellulases, lipases, phospholipases, pectinases, galactosidases, laccases, amylases, hemicellulases, or cellobiohydrolases. The hydrolytic enzymes may be expressed in the transgenic plants or parts thereof included in the feed supplement. The feed supplement may include purified hydrolytic enzymes. The feed supplements may be but are not limited to growth improving additives, coloring agents, flavorings, stabilizers, limestone, stearine, starch, saccharides, fatty acids, or a gum. The coloring agents may be carotenoids. The carotenoids may be but are not limited to cantaxanthin, beta-carotene, astaxanthin, or lutein. The fatty acids may be polyunsaturated fatty acids. The polyunsaturated fatty acids may include but are not limited to arachidonic acid, docosohexaenoic acid (DHA), eicosapentaenoic acid (EPA) or gamma-linoleic acid. The plant material may be a non-transgenic plant or part thereof. The plant material may include at least one component selected from the group consisting of: barley, wheat, rye, oat, corn, rice, triticale, beet, sugar beet, spinach, cabbage, quinoa, corn meal, corn pellets, corn oil, distillers grains, forage, wheat meal, wheat pellets, wheat grain, barley grain, barley pellets, soybean meal, soybean oilcake, lupin meal, rapeseed meal, sorghum grain, sorghum pellets, rapeseed, sunflower seed, and cotton seed.

The feed supplement may include at least one component selected from the group consisting of: soluble solids, fat and vermiculite, limestone, plain salt, DL-methionine, L-lysine, L-threonine, COBAN®, vitamin premix, dicalcium phosphate, selenium premix, choline chloride, sodium chloride, and mineral premix. The feed supplement may include fish meal, fish oil, bone meal, feather meal and animal fat. The feed supplement may include yeast or yeast extract.

An embodiment provides a method of producing an animal feedstock. The method may include mixing any one of the maize plants or parts thereof described herein, or the progeny thereof with plant material. The maize plant may be a progeny of the transgenic maize plant comprising one or more synthetic nucleic acids described herein and included in a genetic construct(s) or an expression cassette(s) described herein. The method may comprise making any transgenic maize plant herein. The transgenic maize plant or its progeny may be the maize plant, in which phytase levels may be increased by the method herein. The method may further include pelletizing the mixture. The method may further include adding a feed supplement to the mixture. The feed supplement may include at least one exogenous enzyme. The at least one exogenous enzyme may be a hydrolase selected from the group consisting of: xylanase, mannanase, protease, glucanase, and cellulase. Preparing the animal feedstock may include combining one or more transgenic maize plants herein with any other feed supplement.

The phytase may be isolated, purified and added to the animal feedstock as a pure phytase. The phytase may be added to the animal feedstock in admixture with other feed supplements. The transgenic plant including the phytase or the purified phytase may be combined with other feed supplements to form premixes.

An animal feedstock may be produced as mash feed. The animal feedstock may be produced as pellets. The milled feed stuffs may be mixed with the premix that includes any one of the transgenic maize plants or parts thereof that include a phytase. The phytase may be gastric labile. The phytase may be gastric stable. The milled stuffs may include the plant material and the feed supplements described herein. The feed supplements may include one or more exogenous enzymes described herein. Enzymes may be added as liquid or solid formulations. For mash feed, a solid or liquid enzyme formulation may be added before or during the mixing step. For pelleted feed, the enzyme preparation may be added before or after the pelleting step. The phytase may be included in premix. The premix may also include vitamins and trace minerals. Macro minerals may be added separately to animal feedstock.

In an embodiment, a method of enhancing thermal stability of a phytase is provided. The method may include producing a transgenic plant that comprises one or more synthetic nucleic acid encoding the phytase. The one or more synthetic nucleic acids may include any one the sequences described herein. The one or more synthetic nucleic acids may encode any one of the phytases described herein. The phytase may be thermally stable upon exposure to a temperature in the range of 70° C. to 90° C., endpoints inclusive. The phytase may be thermally stable upon exposure to temperatures in the range of 60° C. to 90° C., endpoints inclusive. The phytase may be thermally stable upon exposure to a temperature in the range from 60° C., 65° C., 70° C., 75° C., 80° C., 85° C., 90° C., 60° C., to 65° C., 60° C. to 70° C., 60° C. to 75° C., 60° C. to 80° C., 60° C. to 85° C., 60° C. to 90° C., or less than 90° C. The thermally stable phytase may be gastric labile. The thermally stable phytase may be gastric stable.

The synthetic nucleic acids described herein may be provided alone, as part of another nucleic acid, as part of a vector or as part of a transgenic maize plant.

An embodiment provides a method of promoting the release of inorganic phosphate from a phytic acid or phytate in an animal. The method may include feeding an animal with an animal feedstock that includes any one of the maize plants or parts thereof described herein, or the progeny thereof. The method may further include preparing the animal feedstock according to any one of the methods described herein. The animal feedstock may contain high, adequate, or deficient levels of dietary phosphate. The animal may be a monogastric animal. The animal may be a ruminant animal. For monogastric animals, adequate non-phytate phosphorous levels range from 0.30% (w/w) to 0.50% (w/w) for poultry, and standardized total tract digestible phosphorous levels for swine range between 0.20% (w/w) to 0.50% (w/w), endpoints inclusive. Deficient, or reduced, levels of dietary phosphorous are less than the adequate levels of phosphorous described herein, down to 0%. High levels of dietary phosphorous are greater than the adequate levels of phosphorous described herein, up to 100% phosphorous.

An embodiment provides a method of promoting the release of inorganic phosphate from a phytic acid or phytate in a plant. The method may include expressing a phytase enzyme at increased levels relative to the non-transgenic, or non-intragenic, or cisgenic, plant of the same species. The phytase may be gastric labile. The phytase may be gastric stable. The method may include expressing a phytase in maize plants or parts thereof described herein, or the progeny thereof. The maize plant expressing phytase may have a decreased physiological or growth requirement for phosphate relative to the non-transgenic, non-intragenic or non-cisgenic plant of the same species.

In an embodiment, a method of increasing apparent metabolizable energy of a diet is provided. The method may include expressing a phytase in a plant or part thereof described herein. The method may include providing a composition that contains a plant or plant part thereof described herein. The composition may include a gastric labile phytase. The composition may include a gastric stable phytase. The method may include providing a plant or plant part thereof comprising any one of the phytases described herein at a level appropriate to feeding animals. The appropriate levels of phytases may be phytase doses that are greater than or equal to 250 FTU/kg, greater than or equal to 500 FTU/kg, greater than or equal to 1000 FTU/kg, greater than or equal to 1500 FTU/kg, greater than or equal to 2000 FTU/kg, greater than or equal to 3000 FTU/kg, greater than or equal to 4500 FTU/kg, greater than or equal to 6000 FTU/kg, greater than or equal to 30,000 FTU/kg, or greater than or equal to 60,000 FTU/kg. Metabolizable energy (ME) refers to the net energy of a diet or feed that is available to an animal after the utilization of some energy in the processes of digestion and absorption and the loss of some of the material as being undigested or indigestible. Metabolizable energy may be apparent metabolizable energy (AME) measured as the difference between the calories of the feed consumed by an animal and excrements collected after feed consumption. Metabolizable energy may be true metabolizable energy (TME), which is similar to AME except that it also takes into account endogenous energy. Energy contents in a diet or feed ingredients may be determined using one of several methodologies (NRC. 1994. Nutrient Requirements of Poultry. 9th rev. ed. Natl. Acad. Press, Washington, D.C., which is incorporated herein by reference as if fully set forth). Gross energy (GE) is direct measurement using an adiabatic bomb calorimeter, which measures the heat of combustion of a sample within a high oxygen atmosphere. Apparent digestible energy (DE) is GE of a feed or feedstuff minus GE of feces only. Apparent metabolizable energy (AME) is GE of a feed or feedstuff minus GE of feces, urine, and gaseous products from digestion. For poultry, the gaseous release is very low, and typically neglected due to its very small value, and the urine and feces are excreted together and are not collected separately in most cases. True metabolizable energy (TME) accounts for only the GE from excreta that is from the feed or feedstuff origin, by subtracting the endogenous energy loss from non-feed origin (i.e. sloughing of intestinal tract cells), which may measured using an unfed control population. Another energy measurement used for feedstuffs in animals is net energy (NE) which adjusts for heat increment. Since heat increment is dependent on level of productivity, which fluctuates in poultry because of short lifespan, this variable is not frequently used in poultry.

The TME rooster assay may be used to account for endogenous (non-feed) losses of GE by including a fasted rooster and collecting excreta to correct the GE from the fed (feed/feedstuff) rooster. See Sibbald, 1976, Poultry Science 55: 303-308, which is incorporated herein by reference as if fully set forth. This assay has commonly been used for determining TME of individual feedstuffs rather than complete feed, and requires cecetomized roosters (ceca surgically removed) to always be on hand. The assay involves force-feeding (into the crop) a known quantity of an ingredient (in birds that were previously fasted 24-48 hr) and then collect feces for a 24-48 hour period. The equation used to calculate TME is given as $TME=\{(GE_f \times FI)-[(GE_e \times EO)^+ -(GE_e \times EO)^-]\}/FI$, where Gross Energy (GE) is determined by bomb calorimetry in kcal/kg; FI is feed intake (kg); DO is excreta output fed birds (kg); $GE_e$ is the Gross Energy of the excreta content; $GE_f$ is the Gross Energy of the feed; "+" signifies the quantity is from the fed birds energy output; and "−" signifies that the quantity is from the fasted birds energy output. The roosters (or turkeys) used in TME assays are adult birds with a fully developed digestive tract. Research has shown that there are differences in ME determinations using roosters (layer breeds), turkeys and broilers when analyzing same feed ingredients (Cozannet et al, 2010 J. Anim, Sci., 88(7):2382-2392, which is incorporated herein by reference as if fully set forth). So determining TME or AME using rooster model may not be equivalent to what is observed in a young broiler, but is one proxy in research and industry.

For broilers, the AME assay may be used for determining complete feed and some energy supplying feedstuffs, as well as the effect from adding feed ingredients that aid in digestion. There are two common methods for determining ME: 1) doing a total excreta collection and weighing and record feed consumption during the time period (Equation 1 below) or 2) using an indigestible marker in feed (chromic oxide, titanium oxide or acid insoluble ash) and taking a subsample of feces with no weighing required (Equation 2 below). The marker method of AME determination may be used, in which no weighing of feed consumption or total fecal collection and no need to separate feed spilled from feces pan are required. With the marker method, birds are fed the marker for at least two days (but preferably five or more days). Feces are collected over several days (e.g., three days) with daily collection composited into one sample.

AME using the total collection method (Equation 1) is calculated as follows:

$$AME=[(GE_f \times FI)-(GE_e \times EO)]/FI,$$

where Gross Energy (GE) is measured in bomb calorimetry (kcal/kg); FI is feed intake (kg); DO is excreta output (kg); $_e$ refers to excreta content; and $_f$ refers to the feed content. AME using the marker method is calculated as $AME=[(GE_e/M_e)-(GE_f/M_f)]/(GE_e/M_e)$, where Gross Energy is GE (kcal/kg); M is the marker (ppm or %); "$_e$"=excreta content; "$_f$"=feed content.

Another method that may be used to determine AME of feed when investigating feed additives that aid in digestion is ileal digestible energy (IDE). This method uses the AME marker method (described above), but the birds are euthanized and a section of ileum excised and contents removed, dried and analyzed for GE and the marker. The IDE method may be used effectively for testing and comparing feed additives used to improve digestion/absorption of feed energy. The benefit of IDE, is no cages with collection pans are required and can collect during a floor-pen study. With the marker method, birds are fed the marker for at least two days (and preferably five or more days).

AME using the IDE marker method (Equation 2) is calculated as follows:

$$AME=GE_f-(GE_d \times M_f/M_d),$$

where GE (kcal/kg); M represents the marker; "$_d$" represents the digesta content; and "$_f$" signifies the feed content.

AME and TME may be corrected for nitrogen retention (AMEn and TMEn). To adjust, the grams of N are multiplied by 8.22 kcal/g (GE of uric acid; primary excretory product of protein tissue oxidized for energy), which also is subtracted off of the GE consumed. See Hill, F. W., and D. L. Anderson, 1958, "Comparison of metabolizable energy and productive energy determinations with growing chicks." J. Nutr. 64:587-603, which is incorporated herein by reference as if fully set forth. Calculations for total collection of marker method for AMEn are shown in Equation 3 and Equation 4 below, respectively.

Equation 3: AMEn, total collection:

$$AMEn=\{(GE_f \times FI)-(GE_e \times EO)-[8.22 \times (N_f-N_e)]\}/FI,$$

where GE=kcal/kg; FI=feed intake (kg); EO=excreta output (kg); N=nitrogen (g); $_e$=excreta content; $_f$=feed content.

Equation 4: IDEn, marker method:

$$AMEn=GE_f-(GE_d \times M_f/M_d)-\{8.22 \times [N_f-(N_d \times M_f/M_d)]\},$$

where GE=kcal/kg; M=marker; N=nitrogen (g/kg) "$_d$"=digesta content; "$_f$"=feed content.

While the TME method may be used for determining ME of individual ingredients, the AME (IDE) method may be used with broilers to measure ME in individual ingredients or total diet and testing effects improving ME by use of enzymes or other feed additives.

A diet or feed may include any feed ingredient or mixture of ingredients including water. The diet may be any food, feed, feed composition, diet, preparation, additive, supplement, or mixture included in an animal feedstock described herein. The diets are known in the art and described at least in the following publications: Nutrient Requirements of Poultry, 1994, National Research Council, National Academy Press, Washington, D.C.; Broiler Performance and Nutrition Supplement, Cobb-500™, L-2114-07EN, July, 2015; Broiler Performance and Nutrition Supplement, Cobb-700™, L-21124-13EN, Dec. 21, 2012; Broiler Performance and Nutrition Supplement, CobbAvian™, L-2144-04EN, April, 2012; Broiler Performance and Nutrition Supplement, CobbSasso™, L-2154-01, May 7, 2008; Ross 308 Broiler: Nutrition Specifications, 2014 Aviagen, 0814-AVNR-035; Ross Nutrition Supplement 2009, Aviagen; Ross 708 Broiler: Nutrition Specification, 2014 Aviagen, 0814-AVNR-036; Ross PM3 Brioler Nutrition Specification, 2014 Aviagen, 0814-AVNR-037; Arbor Acres Plus Broiler Nutrition Specifications, 2014 Aviagen, 1014-AV-NAA-043; Arbor Acres Broiler Nutrition Supplement, 2009 Aviagen; and Association of American Feed Control Officials (AAFCO) 2015 Official Publication, Nutrient Requirements for Poultry, all of which are incorporated herein by reference as if fully set forth.

In an embodiment, the diet may be a diet for chickens ("broilers"). The diet for broilers may be composed of one or more of the following ingredients: 51.49% (w/w)-61.86% (w/w) corn, 25.45% (w/w)-35.03% (w/w) soybean meal, up to 5.00% (w/w) corn distillers dry grains plus soluble solids, up to 2.00% (w/w) vermiculite, 0.30% (w/w)-1.99% (w/w) dicalcium phosphate, 1.00% (w/w) poultry fat, 0.81% (w/w)-4.01% (w/w) limestone, 0.24% (w/w)-0.50% (w/w) salt (NaCl), 0.13% (w/w)-0.45% (w/w) DL-methionine, 0.20% (w/w) choline chloride 60, 0.20% (w/w) mineral premix, 0.05% (w/w) vitamin premix, 0.13% (w/w)-0.23% (w/w) L-lysine, 0.08% (w/w)-0.14% (w/w) L-threonine, 0.05% (w/w) coban, 0.05% (w/w) selenium premix, 0.15% (w/w) sodium bicarbonate and up to 0.10% (w/w) sand. The concentration of each ingredient within any one of the ranges herein may be any value between any two of the concentration points included in the range. Digestible lysine in the diet may be 1.00% (w/w) to 1.20% (w/w). Digestable lysine may be 1.10% (w/w), 1.11% (w/w). 1.12% (w/w), 1.13%0.47% (w/w), (w/w), 1.14% (w/w), 1.15% (w/w), 1.16% (w/w), 1.17% (w/w), 1.18% (w/w), 1.19% (w/w), or 1.20% (w/w), or any value between any two of the foregoing concentration points. Digestible methionine in the diet may be 0.47% (w/w) to 0.54% (w/w). Digestible methionine may be 0.47% (w/w), 0.48% (w/w), 0.49% (w/w), 0.50% (w/w), 0.51% (w/w), 0.52% (w/w), 0.53% (w/w), or 0.54% (w/w), or any value between any two of the foregoing concentration points. Digestible methionine and cysteine in the diet may be 0.98% (w/w) to 1.10% (w/w). Digestible methionine and cysteine may be 0.98% (w/w), 0.99% (w/w), 1.00% (w/w), or 1.10% (w/w), or any value between any two of the foregoing concentration points. Digestible threonine in the diet may be 0.68% (w/w) to 0.84% (w/w). Digestible threonine may be 0.68% (w/w), 0.69% (w/w), 0.70% (w/w), 0.71% (w/w), 0.72% (w/w), 0.73% (w/w), 0.74% (w/w), 0.75% (w/w), 0.76% (w/w), 0.77% (w/w), 0.78% (w/w), 0.79% (w/w), 0.80% (w/w), 0.81% (w/w), 0.82% (w/w), 0.83% (w/w), or 0.84% (w/w), or any value between any two of the foregoing concentration points. Digestible tryptophan in the diet may be 0.17% (w/w) to 0.22% (w/w). Digestible tryptophan may be 0.17% (w/w), 0.18% (w/w), 0.19% (w/w), 0.20% (w/w), 0.21% (w/w), or 0.22% (w/w), or any value between any two of the foregoing concentration points. Calcium in the diet may be 0.71% (w/w) to 0.96% (w/w). Calcium may be 0.71% (w/w), 0.72% (w/w), 0.73% (w/w), 0.74% (w/w), 0.75% (w/w), 0.76% (w/w), 0.77% (w/w), 0.78% (w/w), 0.79% (w/w), 0.80% (w/w), 0.81% (w/w), 0.82% (w/w), 0.83% (w/w), 0.84% (w/w), 0.85% (w/w), 0.86% (w/w), 0.87% (w/w), 0.88% (w/w), 0.89% (w/w), 0.90% (w/w), 0.91% (w/w), 0.92% (w/w), 0.93% (w/w), 0.94% (w/w), 0.95% (w/w), or 0.96% (w/w), or any value between any two of the foregoing concentration points. Available phosphorus in the diet may be 0.17% (w/w) to 0.46% (w/w). Available phosphorus in may be 0.17% (w/w), 0.18% (w/w), 0.19% (w/w), 0.20% (w/w), 0.21% (w/w), 0.22% (w/w), 0.23% (w/w), 0.24% (w/w), 0.25% (w/w), 0.26% (w/w), 0.27% (w/w), 0.28% (w/w), 0.29% (w/w), 0.30% (w/w), 0.31% (w/w), 0.32% (w/w), 0.33% (w/w), 0.34% (w/w), 0.35% (w/w), 0.36% (w/w), 0.37% (w/w), 0.38% (w/w), 0.39% (w/w), 0.40% (w/w), 0.41% (w/w), 0.42% (w/w), 0.43% (w/w), 0.44% (w/w), 0.45% (w/w), or 0.46% (w/w), or any value between any two of the foregoing concentration points. Sodium in the diet may be 0.17% (w/w) to 0.19% (w/w). Sodium in the diet may be 0.17% (w/w), 0.18% (w/w), or 0.19% (w/w), or any value between any two of the foregoing concentration points.

In an embodiment, the diet may be the diet for broilers composed of one or more of the following ingredients: 30.00% (w/w)-75.00% (w/w) corn, 5.00% (w/w)-75.00% (w/w) wheat; 5.00% (w/w)-65.00% (w/w) barley; 5.00% (w/w)-30.00% (w/w) sorghum, 5.00% (w/w)-50.00% (w/w) millet, 10.00% (w/w)-45.00% (w/w) soybean meal, 5.00% (w/w)-20.00% (w/w) Canola (Rapeseed) meal, 2.00% (w/w)-15.00% (w/w) corn gluten meal, 5.00% (w/w)-15.00% (w/w) sunflower meal, 5.00% (w/w)-30.00% (w/w) corn distillers dry grains plus soluble solids, 1.00% (w/w)-8.00% (w/w) poultry/porcine/bovine meat and bone meal, 1.00% (w/w)-8.00% (w/w) fish meal, 0.10% (w/w)-2.1% (w/w) dicalcium or monocalcium or defluorinated phosphate, 0.50% (w/w)-6.00% (w/w) soy oil or vegetable oil or animal fat or grease or combination, 0.81% (w/w)-2.00% (w/w) limestone, 0.50% (w/w)-7.00% (w/w) soy hulls, 0.24% (w/w)-0.50% (w/w) salt (NaCl), 0.13% (w/w)-0.50% (w/w) DL-methionine, 0.01% (w/w)-0.20% (w/w) choline chloride 60, 0.10% (w/w)-0.20% (w/w) mineral premix, 0.05% (w/w)-0.25% (w/w) vitamin premix, 0.05% (w/w)-0.30% (w/w) L-lysine, 0.10% (w/w)-0.30% (w/w) DL-Methionine or methionine analog (MHA), 0.05% (w/w)-0.20% (w/w) L-threonine, 0.05% (w/w) coban, 0.05% (w/w) selenium premix, 0.05% (w/w)-0.15% (w/w) sodium bicarbonate and 250 FTU/kg-60,000 FTU/kg Phytase. The concentration of each ingredient within any one of the ranges herein may be any value between any two of the concentration points included in the range. Metabolizable energy of the diet may be 1225 (kcal/lb)-1491 (kcal/lb). Metabolizable energy may be 1225 (kcal/lb), 1230 (kcal/lb), 1240 (kcal/lb), 1250 (kcal/lb), 1260 (kcal/lb), 1270 (kcal/lb), 1280 (kcal/lb), 1290 (kcal/lb), 1300 (kcal/lb), 1310 (kcal/lb), 1320 (kcal/lb), 1330 (kcal/lb), 1340 (kcal/lb), 1350 (kcal/lb), 1360 (kcal/lb), 1370 (kcal/lb), 1380 (kcal/lb), 1390 (kcal/lb), 1400 (kcal/lb), 1410 (kcal/lb), 1420 (kcal/lb), 1430 (kcal/lb), 1440 (kcal/lb), 1450 (kcal/lb), 1460 (kcal/lb), 1470 (kcal/lb), 1480 (kcal/lb), 1490 (kcal/lb), or 1491 (kcal/lb), or any value between any two of the foregoing concentration points. Crude protein (CP) in the diet may be 15% (w/w) to 25% (w/w). Crude protein (CP) may be 15% (w/w), 16% (w/w), 17% (w/w), 18% (w/w), 19% (w/w), 20% (w/w), 21% (w/w), 22% (w/w), 23% (w/w), 24% (w/w), or 25% (w/w), or any value between any two of the foregoing concentration points. Digestible lysine in the diet may be 0.85% (w/w) to 1.30% (w/w). Digestible lysine may be 0.85% (w/w), 0.86% (w/w), 0.87% (w/w), 0.88% (w/w), 0.89% (w/w), 0.90% (w/w), 0.91% (w/w), 0.92% (w/w), 0.93% (w/w), 0.94% (w/w), 0.95% (w/w), 0.96% (w/w), 0.97% (w/w), 0.98% (w/w), 0.99% (w/w), 1.00% (w/w), 1.20% (w/w), or 1.30% (w/w), or any value between any two of the foregoing concentration points. Digestible methionine in the diet may be 0.45% (w/w) to 0.70% (w/w). Digestible methionine may be 0.45% (w/w), 0.50% (w/w), 0.55% (w/w), 0.60% (w/w), 0.65% (w/w), or 0.70% (w/w), or any value between any two of the foregoing concentration points. Digestible methionine and cystine in the diet may be 0.65% (w/w) to 1.10% (w/w). Digestible methionine and cystine may be 0.65% (w/w), 0.70% (w/w), 0.75% (w/w), 0.80% (w/w), 0.85% (w/w), 0.90% (w/w), 0.95% (w/w), 1.00% (w/w), 1.05% (w/w), or 1.10% (w/w), or any value between any two of the foregoing concentration points. Digestible threonine in the diet may be 0.60% (w/w) to 0.84% (w/w). Digestible threonine may be 0.60% (w/w), 0.65% (w/w), 0.70% (w/w), 0.75% (w/w), 0.80% (w/w), or 0.84% (w/w), or any value between any two of the foregoing concentration points. Digestible tryptophan in the diet may be 0.10% (w/w) to 0.25% (w/w). Digestible tryptophan may be 0.10% (w/w), 0.15% (w/w), 0.20% (w/w), or 0.25% (w/w), or any value between any two of the foregoing concentration points. Calcium in the diet may be 0.68% (w/w) to 1.10% (w/w). Calcium in the diet may be 0.68% (w/w), 0.69% (w/w), 0.70% (w/w), 0.75% (w/w), 0.80% (w/w), 0.85% (w/w), 0.90% (w/w), 0.95% (w/w), 1.00% (w/w), or 1.10% (w/w), or any value between any two of the foregoing concentration points. Available phosphorus in the diet may be 0.17% (w/w) to 0.60% (w/w). Available phosphorus may be 0.17% (w/w), 0.18% (w/w), 0.19% (w/w), 0.20% (w/w), 0.25% (w/w), 0.30% (w/w), 0.35% (w/w), 0.40% (w/w), 0.45% (w/w), 0.50% (w/w), 0.55% (w/w), or 0.60% (w/w), or any value between any two of the foregoing concentration points. Sodium in the diet may be 0.17% (w/w) to 0.19% (w/w). Sodium may be 0.17% (w/w), 0.18% (w/w), or 0.19% (w/w), or any value between any two of the foregoing concentration points. Phytase in the diet may be 500 FTU/kg (w/w) to 8,000 FTU/kg (w/w). Phytase may be 500 FTU/kg (w/w), 600 FTU/kg (w/w), 700 FTU/kg (w/w), 800 FTU/kg (w/w), 900 FTU/kg (w/w), 1000 FTU/kg (w/w), 1100 FTU/kg (w/w), 1200 FTU/kg (w/w), 1300 FTU/kg (w/w), 1400 FTU/kg (w/w), 1500 FTU/kg (w/w), 1600 FTU/kg (w/w), 1700 FTU/kg (w/w), 1800 FTU/kg (w/w), 1900 FTU/kg (w/w), 2000 FTU/kg (w/w), 2100 FTU/kg (w/w), 2200 FTU/kg (w/w), 2300 FTU/kg (w/w), 2400 FTU/kg (w/w), 2500 FTU/kg (w/w), 2600 FTU/kg (w/w), 2700 FTU/kg (w/w), 2800 FTU/kg (w/w), 2900 FTU/kg (w/w), 3000 FTU/kg (w/w), 3100 FTU/kg (w/w), 3200 FTU/kg (w/w), 3300 FTU/kg (w/w), 3400 FTU/kg (w/w), 3500 FTU/kg (w/w), 3600 FTU/kg (w/w), 3700 FTU/kg (w/w), 3800 FTU/kg (w/w), 3900 FTU/kg (w/w), 4000 FTU/kg (w/w), 4100 FTU/kg (w/w), 4200 FTU/kg (w/w), 4300 FTU/kg (w/w), 4400 FTU/kg (w/w), 4500 FTU/kg (w/w), 4600 FTU/kg (w/w), 4700 FTU/kg (w/w), 4800 FTU/kg (w/w), 4900 FTU/kg (w/w), 5000 FTU/kg (w/w), 5100 FTU/kg (w/w), 5200 FTU/kg (w/w), 5300 FTU/kg (w/w), 5400 FTU/kg (w/w), 5500 FTU/kg (w/w), 5600 FTU/kg (w/w), 5700 FTU/kg (w/w), 5800 FTU/kg (w/w), 5900 FTU/kg (w/w), 6000 FTU/kg (w/w), 6100 FTU/kg (w/w), 6200 FTU/kg (w/w), 6300 FTU/kg (w/w), 6400 FTU/kg (w/w), 6500 FTU/kg (w/w), 6600 FTU/kg (w/w), 6700 FTU/kg (w/w), 6800 FTU/kg (w/w), 6900

FTU/kg (w/w), 7000 FTU/kg (w/w), 7100 FTU/kg (w/w), 7200 FTU/kg (w/w), 7300 FTU/kg (w/w), 7400 FTU/kg (w/w), 7500 FTU/kg (w/w), 7600 FTU/kg (w/w), 7700 FTU/kg (w/w), 7800 FTU/kg (w/w), 7900 FTU/kg (w/w), or 8,000 FTU/kg (w/w), or any value between any two of the foregoing concentration points. The concentration of each ingredient within any one of the ranges herein may be any value between any two of the concentration points included in the range. Variations in the concentrations of these ingredients may also be used in a diet.

The method may include mixing a transgenic, intragenic or cisgenic maize plant or part thereof with a feed ingredient to obtain a mixture. The feed ingredient may be one or more ingredients included in the diet described herein. The transgenic, intragenic or cisgenic maize plant or part thereof may be any transgenic, intragenic or cisgenic maize plant or part thereof described herein. The mixture may contain a gastric labile phytase. The mixture may contain a gastric stable phytase. The method may include feeding an animal with the mixture. The body weight gain (BWG) in an animal fed with the mixture comprising a phytase may be higher than the BWG in a control animal fed with identical feed ingredients not mixed with a transgenic plant including a phytase. In an embodiment, the BWG in an animal fed with the mixture comprising a phytase may be similar to the BWG in a control animal fed with a high energy diet or a diet that includes more or higher concentrations of the ingredients compared to the mixture including a phytase. In an embodiment, the BWG in an animal fed with a mixture comprising phytase may be greater than the BWG in a control animal fed the same mixture, or the same mixture including a lower dose of phytase. In an embodiment, the BWG in an animal fed with a mixture comprising phytase at a dose between 3000 FTU/kg up to and including 60,000 FTU/kg with high or adequate dietary phosphate may be greater than the BWG in a control animal fed the same mixture with a phytase dose below 3000 FTU/kg. In an embodiment, the feed conversion ratio (FCR) in an animal fed with the mixture comprising a phytase may be lower than the FCR in a control animal fed with identical feed ingredients not mixed with a transgenic plant including a phytase. The FCR is defined as the mass of the feed eaten by the animal divided by the animal's mass. In an embodiment, the FCR in an animal fed with the mixture comprising a phytase may be similar to the FCR in a control animal fed with a high energy diet or a diet that includes more or higher concentrations of the ingredients compared to the mixture including a phytase. In an embodiment, the FCR in an animal fed with a mixture comprising phytase may be equal to the FCR in a control animal fed a similar mixture with lower dietary phosphate, amino acids, or energy, or the same mixture including a lower dose of phytase. In an embodiment, the FCR in an animal fed with a mixture comprising phytase at a dose between 3000 FTU/kg up to and including 60,000 FTU/kg with high or adequate dietary phosphate may be equal to the FCR in a control animal fed a similar mixture with a phytase dose below 3000 FTU/kg and with a lower dietary phosphate, amino acid, or energy concentration.

In an embodiment, a method of reducing the ratio of feed intake per the breast meat weight in an animal is provided. The method may include feeding the animal with a diet comprising a phytase. The phytase may be provided at a dose equal to, or greater than, 1000 FTU/kg. The phytase may be at a dose equal to, or greater than, 1000 FTU/kg but lesser than, or equal to, 4500 FTU/kg. The diet may include an adequate or reduced amount of Ca. The adequate amount of Ca may be 1.0% (w/w) of Ca in a diet. The reduced amount of Ca may be 0.95% (w/w), 0.9% (w/w), 0.85% (w/w), or 0.8% (w/w), or any value between any two of the foregoing concentration points. The reduced amount of Ca may be 0.79% (w/w), or lower amount of Ca in a diet. The diet may include an adequate or reduced amount of available phosphate. The adequate amount of available phosphate may be 0.5% (w/w) of phosphate in a diet. The reduced amount of available phosphate may be 0.45% (w/w), 0.4% (w/w), 0.35% (w/w), 0.3% (w/w), or any value between any two of the foregoing concentration points. The reduced amount of available phosphate may be 0.29% (w/w), or lower amount of phosphate in a diet. The diet may include an adequate or reduced amount of one or more amino acids. The one or more amino acid may be a digestable lysine. The adequate amount of the digestable lysine may be greater or equal to 1.19% (w/w). The reduced amount of the digestable lysine may be lesser or equal to 1.18% (w/w), 1.16% (w/w), 1.14% (w/w), 1.12% (w/w), 1.1% (w/w), 1.0% (w/w), 0.9% (w/w), 0.98% (w/w), 0.96% (w/w), 0.94% (w/w), 0.92% (w/w), 0.90% (w/w), or 0.8% (w/w) of the digestable lysine, or any value between any two of the foregoing concentration points. The one or more amino acids may be a combination of a digestable methionine and a digestable cysteine. The adequate amount of the combination of the digestable methionine and the digestable cysteine may be greater or equal to 0.89% (w/w). The reduced amount of the combination of the digestable methionine and the digestable cysteine may be lesser or equal to 0.88% (w/w), 0.87% (w/w), 0.86% (w/w), 0.85% (w/w), 0.84% (w/w), 0.83% (w/w), 0.82% (w/w), 0.81% (w/w), 0.80% (w/w), 0.79% (w/w), 0.78% (w/w), 0.77% (w/w), 0.76% (w/w), 0.75% (w/w), 0.74% (w/w), 0.73% (w/w), 0.72% (w/w), 0.71% (w/w), 0.70% (w/w), or 0.69% (w/w) of the combination of the digestable methionine and the digestable cysteine, or any value between any two of the foregoing concentration points. The one or more amino acids may be a digestable threonine. The adequate amount of the digestable threonine may be greater or equal to 0.78% (w/w). The reduced amount of the digestable threonine may be lesser or equal than 0.77% (w/w), 0.76% (w/w), 0.75% (w/w), 0.76% (w/w), 0.75% (w/w), 0.74% (w/w), 0.73% (w/w), 0.72% (w/w), 0.71% (w/w), 0.70% (w/w), 0.69% (w/w), 0.68% (w/w), 0.67% (w/w), 0.66% (w/w), 0.65% (w/w), 0.64% (w/w), 0.63% (w/w), 0.62% (w/w), 0.61% (w/w), or 0.60% (w/w) of the digestable threonine, or any value between any two of the foregoing concentration points. The one or more amino acids may be any other amino acid commonly used in the diet. The diet may include adequate or reduced energy levels of the ingredients. The adequate energy level of the ingredients may be greater or equal to 1460 kcal/lb. The reduced energy level of the ingredients may be lesser or equal to 1450 kcal/lb, 1440 kcal/lb, 1430 kcal/lb, 1420 kcal/lb, 1410 kcal/lb, 1400 kcal/lb, 1390 kcal/lb, 1380 kcal/lb, 1370 kcal/lb, 1360 kcal/lb, 1350 kcal/lb, 1340 kcal/lb, 1330 kcal/lb, 1320 kcal/lb, or 1310 kcal/lb, or any value between any two of the foregoing energy level points. The ratio of feed intake divided by the breast meat weight may be decreased in an animal fed the diet including phytase relative to an animal fed the same diet with a lower dose of phytase or no phytase.

In an embodiment, a method of increasing a breast meat weight in an animal is provided. The method may include feeding the animal with a diet comprising a phytase. The phytase may be provided at a dose equal to, or greater than, 1000 FTU/kg. The phytase may be at a dose equal to, or greater than, 1000 FTU/kg but lesser than, or equal to, 6000 FTU/kg. The phytase may be at a dose of 1000 FTU/kg, 2000 FTU/kg, 3000 FTU/kg, 4000 FTU/kg, 5000 FTU/kg, or 6000 FTU/kg, or any value between any two of the foregoing concentration points. The diet may include an adequate or reduced amount of Ca. The adequate amount of Ca may be 1.0% (w/w) of Ca in a diet. The reduced amount of Ca may be 0.95% (w/w), 0.9% (w/w), 0.85% (w/w), 0.8% (w/w), or any value between any two of the foregoing concentration points. The reduced amount of Ca may be 0.79% (w/w) or lower amount of Ca in a diet. The diet may include an adequate or reduced amount of available phosphate. The adequate amount of available phosphate may be 0.5% (w/w) of phosphate in a diet. The reduced amount of available phosphate may be 0.45% (w/w), 0.4% (w/w), 0.35% (w/w), 0.3% (w/w), or any value between any two of the foregoing concentration points. The reduced amount of phosphate may be 0.29% (w/w), or lower amount of phosphate in a diet. The diet may include an adequate or reduced amount of one or more amino acids. The one or more amino acid may be a digestable lysine. The adequate amount of the digestable lysine may be greater or equal to 1.19% (w/w). The reduced amount of the digestable lysine may be lesser or equal to 1.18% (w/w), 1.16% (w/w), 1.14% (w/w), 1.12% (w/w), 1.1% (w/w), 1.0% (w/w), 0.9% (w/w), 0.98% (w/w), 0.96% (w/w), 0.94% (w/w), 0.92% (w/w), 0.90% (w/w), or 0.8% (w/w) of the digestable lysine, or any value between any two of the foregoing concentration points. The one or more amino acids may be a combination of a digestable methionine and a digestable cysteine. The adequate amount of the combination of the digestable methionine and the digestable cysteine may be greater or equal to 0.89% (w/w). The reduced amount of the combination of the digestable methionine and the digestable cysteine may be lesser or equal to 0.88% (w/w), 0.87% (w/w), 0.86% (w/w), 0.85% (w/w), 0.84% (w/w), 0.83% (w/w), 0.82% (w/w), 0.81% (w/w), 0.80% (w/w), 0.79% (w/w), 0.78% (w/w), 0.77% (w/w), 0.76% (w/w), 0.75% (w/w), 0.74% (w/w), 0.73% (w/w), 0.72% (w/w), 0.71% (w/w), 0.70% (w/w), or 0.69% (w/w) of the combination of the digestable methionine and the digestable cysteine, or any value between any two of the foregoing concentration points. The one or more amino acids may be a digestable threonine. The adequate amount of the digestable threonine may be greater or equal to 0.78% (w/w). The reduced amount of the digestable threonine may be lesser or equal than 0.77% (w/w), 0.76% (w/w), 0.75% (w/w), 0.76% (w/w), 0.75% (w/w), 0.74% (w/w), 0.73% (w/w), 0.72% (w/w), 0.71% (w/w), 0.70% (w/w), 0.69% (w/w), 0.68% (w/w), 0.67% (w/w), 0.66% (w/w), 0.65% (w/w), 0.64% (w/w), 0.63% (w/w), 0.62% (w/w), 0.61% (w/w), or 0.60% (w/w) of the digestable threonine, or any value between any two of the foregoing concentration points. The one or more amino acids may be any other amino acid commonly used in the diet. The diet may include adequate or reduced energy levels of the ingredients. The adequate energy level of the ingredients may be greater or equal to 1460 kcal/lb. The reduced energy level of the ingredients may be lesser or equal to 1450 kcal/lb, 1440 kcal/lb, 1430 kcal/lb, 1420 kcal/lb, 1410 kcal/lb, 1400 kcal/lb, 1390 kcal/lb, 1380 kcal/lb, 1370 kcal/lb, 1360 kcal/lb, 1350 kcal/lb, 1340 kcal/lb, 1330 kcal/lb, 1320 kcal/lb, or 1310 kcal/lb, or any value between any two of the foregoing concentration points. The breast meat weight may be increased in an animal fed the diet including phytase relative to an animal fed the same diet with a lower dose of phytase or no phytase.

The following list includes particular embodiments of the present invention. But the list is not limiting and does not exclude alternate embodiments, as would be appreciated by one of ordinary skill in the art.

Embodiments

1. A maize plant or part thereof comprising one or more synthetic nucleic acids, wherein the one or more synthetic nucleic acids comprise a sequence with at least 90% identity to a sequence selected from the group consisting of: SEQ ID NOS: 11, 13, 15, 17, 19, 21, 23, 25, and 27, or a complement thereof, or the one or more synthetic nucleic acids encode a phytase comprising an amino acid sequence with at least 90% identity to a sequence selected from the group consisting of: SEQ ID NO: 12, 14, 16, 18, 20, 22, 24, 26, and 28.

2. The maize plant or part thereof of embodiment 1, wherein the phytase comprises a sequence with at least 90% identity to a sequence of SEQ ID NO: 12 and a conserved domain having at least 98% identity to amino acid residues 173-383 of SEQ ID NO: 12.

3. The maize plant or part thereof of embodiment 1, wherein the phytase comprises an amino acid sequence with at least 90% identity to an amino acid sequence of SEQ ID NO: 22, and a conserved domain with at least 98% identity to amino acid residues 16-306 of SEQ ID NO: 22.

4. The maize plant or part thereof of embodiment 1, wherein the phytase comprises an amino acid sequence with at least 90% identity to a sequence of SEQ ID NO: 26, and a conserved domain with at least 98% identity to amino acid residues 170-202 of SEQ ID NO: 26.

5. The maize plant or part thereof of embodiment 1, wherein the phytase comprises a sequence with at least 90% identity to a sequence of SEQ ID NO: 28, and a conserved domain with at least 98% identity to amino acid residues 16-306 of SEQ ID NO: 28.

6. The maize plant or part thereof of any one or more of the preceding embodiments, wherein the one or more synthetic nucleic acids are included in an expression cassette.

7. The maize plant or part thereof of embodiments 6, wherein the expression cassette comprises at least one regulatory element operably connected to the synthetic nucleic acid and is selected from the group consisting of: a promoter, a signal peptide, and a terminator.

8. The maize plant or part thereof of embodiment 7 comprising the promoter comprising a sequence with at least 90% identity to a reference sequence selected from the group consisting of: SEQ ID NOS: 1-6.

9. The maize plant or part thereof of any one or more of embodiments 7-8 comprising the signal peptide having a sequence with at least 90% identity to a reference sequence selected from the group consisting of: SEQ ID NOS: 7-10 and 31.

10. The maize plant or part thereof of any one or more of embodiments 7-9 comprising the terminator having a sequence with at least 90% identity to a reference sequence selected from the group consisting of: SEQ ID NOS: 33-35.

11. The maize plant or part thereof of any one or more of the preceding embodiments, wherein the expression cassette comprises a polynucleotide with at least 90% identity to a sequence selected from the group consisting of: SEQ ID NOS: 36, 46-98, 138-149, and 181.

12. A maize plant or part thereof comprising one or more synthetic polynucleotides selected from the group consisting of: SEQ ID NOS: 42, 43, 125, 154, 156, 157, 158, 159, and 175.

13. The maize plant or part thereof of embodiment 12, wherein the one or more synthetic polynucleotides comprise a sequence of SEQ ID NO: 42 or 43, and produce a diagnostic amplicon for identifying event PY203.

14. The maize plant or part thereof of embodiment 12, wherein the one or more synthetic polynucleotides comprise the sequence of SEQ ID NO: 125, and produce a diagnostic amplicon for identifying event PY15.

15. The maize plant or part thereof of embodiment 12, wherein the one or more synthetic polynucleotides comprise the sequence of SEQ ID NO: 154, and produce a diagnostic amplicon for identifying event PY209.

16. The maize plant or part thereof of embodiment 12, wherein the one or more synthetic polynucleotides comprise the sequence of SEQ ID NOS: 156 and 157, and produce a diagnostic amplicon for identifying event PY1053.

17. The maize plant or part thereof of embodiment 12, wherein the one or more synthetic polynucleotides comprise the sequence of SEQ ID NOS: 158 and 159, and produce a diagnostic amplicon for identifying event PY1203.

18. The maize plant or part thereof of embodiment 12, wherein the one or more synthetic polynucleotides comprise the sequence of SEQ ID NO: 175, and produce a diagnostic amplicon for identifying event PY53.

19. A progeny of the maize plant of any one or more of the preceding embodiments.

20. A maize plant or part thereof of any one or more of embodiments 1-18 or the progeny of embodiment 19, wherein the phytase is a gastric labile phytase.

21. A kit for identifying event PY15, PY53, PY203, PY209, PY1053, or PY1203 in a sample, wherein the kit comprises a first primer and a second primer, which are capable of amplifying a synthetic polynucleotide selected from the group consisting of SEQ ID NOS: 126, 128, 130, 131, 133, 135, 136, and 176-184.

22. The kit of embodiment 21, wherein the first primer is a sequence selected from the group consisting of SEQ ID NOS: 100, 105, 107, 110, 120, 121, 161 and 172, and the second primer is a sequence selected from the group consisting of SEQ ID NOS: 99, 104, 109, 119, 164, 170, 171, 173, and 174.

23. A kit for identifying event PY15, PY53, PY203, PY209, PY1053 or PY1203 in a sample, wherein the kit comprises a probe capable of hybridizing to a synthetic polynucleotide comprising a sequence selected from the group consisting of SEQ ID NO: 42, 43, 125, 154, 156, 157, 158, 159, and 175 under conditions of high stringency.

24. A kit for identifying a maize plant or part thereof comprising a phytase in a sample, wherein the kit comprises a probe capable of hybridizing to a synthetic polynucleotide comprising a sequence selected from the group consisting of SEQ ID NO: 36-37, 46-98, 138-149, and 181 under conditions of high stringency.

25. A method of identifying event PY15, PY53, PY203, PY209, PY1053 or PY1203 in a sample comprising:
contacting a sample with a first primer and a second primer; and
amplifying a synthetic polynucleotide comprising a PY15, PY53, PY203, PY209, PY1053 or PY1203 specific region.

26. A method of identifying event PY15, PY53, PY203, PY209, PY1053 or PY1203 in a sample comprising:
contacting a sample with at least one nucleic acid probe that hybridizes to a PY15, PY53, PY203, PY209, PY1053 or PY1203 specific region under conditions of high stringency; and
detecting hybridization of the at least one nucleic acid probe to the PY15, PY53, PY203, PY209, PY1053 or PY1203 specific region.

27. The method of embodiment 26, wherein the at least one nucleic acid probe is selected from the sequence of SEQ ID NOS: 102-103, 112-115, 122-123, 162-163, and 169.

28. An animal feedstock comprising a maize plant or part thereof of any one or more of embodiments 1-18, and 20 or the progeny of any one or both embodiments 19 and 20.

29. The animal feedstock of embodiment 28 further comprising a feed supplement.

30. The animal feedstock of embodiment 28, wherein the feed supplement is plant material.

31. The animal feedstock of embodiment 30, wherein the plant material is a non-transgenic plant or an engineered plant.

32. The animal feedstock of any one or more of embodiments 28-31, wherein the feed supplement includes one or more exogenous enzymes.

33. The animal feedstock of embodiment 32, wherein the one or more exogenous enzymes includes a hydrolytic enzyme selected from the group consisting of: xylanase, endoglucanase, cellulase, protease, glucanase, amylase and mannanase.

34. The animal feedstock of any one or more of embodiments 28-33, wherein the plant material includes at least one component selected from the group consisting of: corn meal, corn pellets, wheat meal, wheat pellets, wheat grain, barley grain, barley pellets, soybean meal, soybean oilcake, sorghum grain and sorghum pellets.

35. The animal feedstock of any one or more of embodiments 28-34, wherein the feed supplement includes at least one component selected from the group consisting of: soluble solids, fat and vermiculite, limestone, plain salt, DL-methionine, L-lysine, L-threonine, COBAN®, vitamin premix, dicalcium phosphate, selenium premix, choline chloride, sodium chloride, and mineral premix.

36. The animal feedstock of any one or more of embodiments 28-35 comprising a phytase dose greater than or equal to 3000 FTU/kg and lesser than or equal to 60,000 FTU/kg.

37. The animal feedstock of any one or more of embodiments 28-36 comprising a phosphate level greater than or equal to 0.35% (w/w), 0.40% (w/w), 0.45% (w/w), 0.50% (w/w), 0.55% (w/w), or 0.60% (w/w) of phosphate per animal feedstock.

38. The animal feedstock of any one or more of embodiments 28-37, wherein any amino acid dose is reduced.

39. The animal feedstock of embodiment 38, wherein any amino acid is a digestable lysine, and the reduced dose is lesser or equal to 1.18% (w/w), 1.16% (w/w), 1.14% (w/w), 1.12% (w/w), 1.1% (w/w), 1.0% (w/w), 0.9% (w/w), 0.98% (w/w), 0.96% (w/w), 0.94% (w/w), 0.92% (w/w), 0.90% (w/w), or 0.8% (w/w) of the digestable lysine.

40. The animal feedstock of embodiment 38, wherein any amino acid is a combination of a digestable methionine and a digestable cysteine, and the reduced dose is lesser or equal to 0.88% (w/w), 0.87% (w/w), 0.86% (w/w), 0.85% (w/w), 0.84% (w/w), 0.83% (w/w), 0.82% (w/w), 0.81% (w/w), 0.80% (w/w), 0.79% (w/w), 0.78% (w/w), 0.77% (w/w), 0.76% (w/w), 0.75% (w/w), 0.74% (w/w), 0.73% (w/w), 0.72% (w/w), 0.71% (w/w), 0.70% (w/w), or 0.69% (w/w) of the combination of the digestable methionine and the digestable cystein.

41. The animal feedstock of embodiment 38, wherein any amino acid is a digestable threonine, and the reduced dose is lesser or equal to 0.77% (w/w), 0.76% (w/w), 0.75% (w/w), 0.76% (w/w), 0.75% (w/w), 0.74% (w/w), 0.73% (w/w), 0.72% (w/w), 0.71% (w/w), 0.70% (w/w), 0.69% (w/w), 0.68% (w/w), 0.67% (w/w), 0.66% (w/w), 0.65%

(w/w), 0.64% (w/w), 0.63% (w/w), 0.62% (w/w), 0.61% (w/w), or 0.60% (w/w) of the digestable threonine.

42. The animal feedstock of any one or more of embodiments 28-41, wherein the energy level of ingredients of the animal feedstock is reduced.

43. The animal feedstock of embodiment 42, wherein the reduced energy level of the ingredients is lesser or equal to 1450 kcal/lb, 1440 kcal/lb, 1430 kcal/lb, 1420 kcal/lb, 1410 kcal/lb, 1400 kcal/lb, 1390 kcal/lb, 1380 kcal/lb, 1370 kcal/lb, 1360 kcal/lb, 1350 kcal/lb, 1340 kcal/lb, 1330 kcal/lb, 1320 kcal/lb, or 1310 kcal/lb.

44. The animal feedstock of any one or more of embodiments 28-43, wherein the phytase is gastric labile.

45. A method of producing an animal feedstock comprising mixing a maize plant or part thereof of any one or more of embodiments 1-18, and 20 or the progeny of any one or both of embodiment 19 and 20 with plant material.

46. The method of embodiment 45 further comprising pelletizing the mixture.

47. The method of any one or both of embodiments 45 or 46 further comprising adding a feed supplement to the mixture.

48. The method of embodiment 47, wherein the feed supplement includes at least one exogenous enzyme.

49. The method of embodiment 48, wherein the at least one exogenous enzyme is a hydrolase selected from the group consisting of: xylanase, mannanase, protease, glucanase, and cellulase.

50. A method of promoting the release of inorganic phosphate from a phytic acid or phytate in an animal comprising feeding an animal with an animal feedstock comprising a maize plant or part thereof of any one or more of embodiments 1-18, and 20 or the progeny of any one or both of embodiments 19 and 20.

51. The method of embodiment 43 further comprising preparing the animal feedstock according to a method of any one or more of embodiments 45-49.

52. The method of any one or both of embodiments 50 or 51, wherein the animal is a monogastric animal or a ruminant animal.

53. A method of producing an animal meat comprising feeding an animal with an animal feedstock comprising a maize plant or part thereof of any one or more of embodiments 1-18, and 20, or the progeny of embodiment 19.

54. The method of embodiment 53 further comprising preparing the animal feedstock according to a method of any one or more of embodiments 45-49.

55. The method of any one or both embodiments 53 and 54, wherein the animal is a monogastric animal or a ruminant animal.

56. The method of any one or more of embodiments 53-55, wherein the animal is the monogastric animal, and the animal meat comprises a breast meat.

57. The method of any one or more of embodiments 53-56, wherein the animal feedstock contains a deficient or an adequate level of phosphate.

58. The method of embodiment 57, wherein animal feedstock contains the adequate level of phosphate, and the adequate level of phosphate is in a range from 0.30% (w/w) to 0.50% (w/w) of phosphate per animal feed or in a range from 0.20% (w/w) to 0.50% (w/w) of phosphate per animal feedstock.

59. The method of embodiment 57, wherein the animal feedstock contains the deficient level of phosphate, and the deficient level of phosphate is less than 20% (w/w) of phosphate per animal feed, or is less than 30% (w/w) of phosphate per animal feedstock.

60. The method of any one or more of embodiments 53-59 wherein the maize plant or part thereof comprises a phytase at a dose equal to 3000 FTU/kg, or greater.

61. The method of any one or more of embodiments 53-59, wherein the maize plant or part thereof comprises a phytase at a dose equal to 60,000 FTU/kg, or lesser.

62. A method of reducing the ratio of intake of an animal feed per weight of the meat in an animal comprising feeding an animal with an animal feedstock comprising a phytase.

63. The method of embodiment 62, wherein the animal feedstock comprise a maize plant or part thereof of any one of claims 1-18, and 20, or the progeny of embodiment 19.

64. The method of any one or both of embodiments 62-63, wherein the phytase is at a dose equal to 3000 FTU/kg, or greater.

65. The method of any one or more of embodiments 62-63, wherein the phytase is at a dose equal to 60,000 FTU/kg, or lesser.

66. The method of any one or more of embodiments 62-65, wherein the animal feed includes an adequate or reduced level of one or more amino acids.

67. The method of embodiment 66, wherein the one or more amino acids is selected from the group consisting of: digestable lysine, digestable methionine, digestable cystein and digestable threonine.

68. The method of embodiment 67, wherein the one or more amino acid is digestable threonine.

69. The method of embodiment 68, wherein the adequate amount of digestable threonine is equal to 0.78% (w/w), or greater, of threonine per animal feedstock.

70. The method of embodiment 68, wherein the reduced amount of digestable threonine is in a range of 0.60% (w/w) to 0.77% (w/w) of threonine per animal feedstock.

71. The method of embodiment 67, wherein the one or more amino acid is digestable lysine.

72. The method of embodiment 71, wherein the adequate amount of digestable lysine is equal to 1.19% (w/w), or greater, of lysine per animal feedstock.

73. The method of embodiment 71, wherein the reduced amount of digestable lysine is in a range of 0.18% (w/w) to 0.80% (w/w) of lysine per animal feedstock.

74. The method of embodiment 67, wherein the one or more amino acid is a combination of a digestable methionine and a digestable cysteine.

75. The method of embodiment 74 wherein the adequate amount of the combination of the digestable methionine and the digestable cysteine is equal to 0.89% (w/w), or greater, of the combination per animal feedstock.

76. The method of embodiment 74, wherein the reduced amount of the combination of the digestable methionine and the digestable cysteine is in a range of 0.69% (w/w) to 0.88% (w/w) of the combination per animal feedstock.

77. The method of any one or more of embodiments 62-76, wherein the animal feedstock contains an adequate or reduced energy level of ingredients.

78. The method of embodiment 77, wherein the animal feedstock contains the adequate energy level of the ingredients, wherein the adequate energy level is equal to 1460 kcal/lb, or greater.

79. The method of embodiment 77, wherein the animal feedstock contains the reduced energy level of the ingredients, wherein the reduced energy level is equal to 1310 kcal/lb, or greater, or less than 1460 kcal/lb.

80. The method of any one or more of embodiments 62-79, wherein the animal feedstock contains a deficient or an adequate level of phosphate.

81. The method of embodiment 80, wherein animal feedstock contains the adequate level of phosphate, and the adequate level of phosphate is in a range from 0.30% (w/w) to 0.50% (w/w) of phosphate per animal feed, or in a range from 0.20% (w/w) to 0.50% (w/w) of phosphate per animal feed.

82. The method of embodiment 80, wherein the animal feedstock contains the deficient level of phosphate, and the deficient level of phosphate is less than 20% (w/w) of phosphate per animal feed, or is less than 30% (w/w) of phosphate per animal feed.

83. The method of any one or more of embodiments 62-82, wherein the animal feedstock contains a deficient or an adequate level of Ca.

84. The method of embodiment 83, wherein animal feedstock contains the adequate level of Ca and the adequate level of Ca is 1.0 (w/w) of Ca per animal feed.

85. The method of embodiment 83, wherein the animal feedstock contains the deficient level of Ca, and the deficient level of Ca is equal to 0.95% (w/w) of Ca per animal feed, or less.

86. The method of any one or more of embodiments 62-85, wherein the ratio is reduced in an animal fed with the animal feedstock comprising phytase compared to an animal fed with a similar animal feedstock containing no phytase or a lower dose of phytase.

Further embodiments herein may be formed by supplementing an embodiment with one or more element from any one or more other embodiment herein, and/or substituting one or more element from one embodiment with one or more element from one or more other embodiment herein.

EXAMPLES

The following non-limiting examples are provided to illustrate particular embodiments. The embodiments throughout may be supplemented with one or more detail from one or more example below, and/or one or more element from an embodiment may be substituted with one or more detail from one or more example below.

Example 1. Descriptions of Expression Cassettes for Phytases

Phytases genes encoding phytase forms have been modified to improve performance as components of feed for monogastric and ruminant animals. These phytases can be expressed directly in feed components such as corn grain and incorporated into animal diets, for example in mash or pelleted feeds for monogastric animals, or in silage or grain for ruminants. Diets containing these plant-expressed phytases require less exogenous inorganic phosphate, and potentially fewer minerals and less energy, to support efficient animal growth. Plant phytases can be expressed intragenically in maize and other crop plants.

Over-expression of plant phytases in plants can be used to increase the feed value of the resulting grain when used as a macrocomponent, microcomponent, or feed additive in animal diets. It also can improve phosphate utilization by the plant. Expressing plant derived phytases, as opposed to microbially derived phytases, in plant species also presents fewer perceived risks to the food chain since these enzymes are already present in the food chain and there is a long history of their tolerance and safe use.

Codon optimized nucleotide sequences for expression of the phytases Phy-02, Phy-02opt, Phy-03, PhyNov9x and PhyQB in maize were synthesized. For generating initial plant transformation constructs, expression cassettes were assembled in transformation vectors. The expression cassettes included the following elements.

Promoters:
maize globulin 1 promoter (SEQ ID NO: 124), maize oleosin 16 (SEQ ID NO: 1), maize PEP carboxylase (SEQ ID NO: 2), maize ubiquitin 1 (with intron) (SEQ ID NO: 3), maize gamma zein 27 (SEQ ID NO: 4), rice glutelin 1 (SEQ ID NO: 5), and rice glutelin B4 (SEQ ID NO: 6).

Signal Peptides:
maize gamma zein 27_coding sequence (SEQ ID NO: 7) and polypeptide sequence (SEQ ID NO: 8), rice glutelin B4 coding sequence (SEQ ID NO: 9) and polypeptide sequence (SEQ ID NO: 10).

Coding Nucleic Acid Sequences and Amino Acid Sequences of Phytases:
PAPhy_b1: coding sequence (SEQ ID NO: 11) and polypeptide sequence (SEQ ID NO: 12), PAPhy_b2: coding sequence (SEQ ID NO: 13) and polypeptide sequence (SEQ ID NO: 14), Phy-02: coding sequence (SEQ ID NO: 15) and polypeptide sequence (SEQ ID NO: 16), Phy-02opt: coding sequence (SEQ ID NO: 17) and polypeptide sequence (SEQ ID NO: 18), Phy-03: coding sequence (SEQ ID NO: 19) and polypeptide sequence (SEQ ID NO: 20), PhyNov9X: coding sequence (SEQ ID NO: 21) and polypeptide sequence (SEQ ID NO: 22), PhyQB: coding sequence (SEQ ID NO: 23) and polypeptide sequence (SEQ ID NO: 24), ZmPhy1: coding sequence (SEQ ID NO: 25) and polypeptide sequence (SEQ ID NO: 26), ZmPhy2: coding sequence (SEQ ID NO: 27) and polypeptide sequence (SEQ ID NO: 28).

C-Terminal Extensions:
HvVSD (from the *Hordeum vulgare* vacuolar sorting determinant (Cervelli et al., 2004)): coding sequence (SEQ ID NO: 29) and polypeptide sequence (SEQ ID NO: 30); SEKDEL (SEQ ID NO: 32) (Endoplasmic reticulum retention signal; (Arakawa, Chong, & Langridge, 1998; Haq, Mason, Clements, & Arntzen, 1995; Korban, 2002; Munro & Pelham, 1987)): coding sequence (SEQ ID NO: 31) and polypeptide sequence (SEQ ID NO: 32).

Terminators/Polyadenylation Signals:
NOS (from the *Agrobacterium tumefaciens* nopaline synthase gene): DNA sequence (SEQ ID NO: 33), CaMV 35s (from the cauliflower mosaic virus 35s transcript; the sequence includes an intron from the maize PEP carboxylase gene): DNA sequence (SEQ ID NO: 34), maize globulin 1: DNA sequence (SEQ ID NO: 35).

The expression cassettes were inserted in the vectors described in Tables 1-6.

TABLE 1

Expression Cassettes in Vectors for Maize-derived Phytase

| Expression cassette* | SEQ ID NO | Promoter | Signal peptide | Coding sequence | Terminator |
| --- | --- | --- | --- | --- | --- |
| pAG4910 | 46 | Maize oleosin 16 | Maize gamma zein 27 | PAPhy_b1 | Maize globulin 1 |
| pAG4902 | 47 | Maize gamma zein 27 | Maize gamma zein 27 | PAPhy_b1 | Maize globulin 1 |
| pAG4911 | 48 | Maize oleosin 16 | Maize gamma zein 27 | PAPhy_b2 | Maize globulin 1 |
| pAG4903 | 49 | Maize gamma zein 27 | Maize gamma zein 27 | PAPhy_b2 | Maize globulin 1 |

TABLE 1-continued

Expression Cassettes in Vectors for Maize-derived Phytase

| Expression cassette* | SEQ ID NO | Promoter | Signal peptide | Coding sequence | Terminator |
|---|---|---|---|---|---|
| pAG4908 | 50 | Maize oleosin 16 | Maize gamma zein 27 | ZmPhy1 | Maize globulin 1 |
| pAG4900 | 51 | Maize gamma zein 27 | Maize gamma zein 27 | ZmPhy1 | Maize globulin 1 |
| pAG4909 | 52 | Maize oleosin 16 | Maize gamma zein 27 | ZmPhy2 | Maize globulin 1 |
| pAG4901 | 53 | Maize gamma zein 27 | Maize gamma zein 27 | ZmPhy2 | Maize globulin 1 |
| pAG4904 | 138 | Maize globulin 1 | Maize gamma zein 27 | ZmPhy1 | Maize globulin 1 |
| pAG4905 | 139 | Maize globulin 1 | Maize gamma zein 27 | ZmPhy2 | Maize globulin 1 |
| pAG4906 | 140 | Maize globulin 1 | Maize gamma zein 27 | PAPhy_b1 | Maize globulin 1 |
| pAG4907 | 141 | Maize globulin 1 | Maize gamma zein 27 | PAPhy_b2 | Maize globulin 1 |

*Expression cassettes are denoted by names of the transformation vectors that contained the cassettes.

TABLE 2

Maize Phytase Sequences in pAG1900-4911 Expression Constructs

| Maize phytase | Vectors | Phytase AA* SEQ ID NO |
|---|---|---|
| ZmPhy1 | pAG4900, pAG4904, pAG4908 | 26 |
| ZmPhy2 | pAG4901, pAG4905, pAG4909 | 28 |
| ZmPAPhy_b1 | pAG4902, pAG4906, pAG4910 | 12 |
| ZmPAPhy_b2 | pAG4903, pAG4907, pAG4911 | 14 |

*amino acid sequence

CLUSTAL O(1.2.1) multiple sequence alignment of *Zea mays* purple acid phosphatases is provided below:

```
ACR23335    TAVPAEPASTLSGPSRPVTVAIGDRGHAVDLPDTDPRVQRRVTGWAPEQVAVALSASPTS      60
ZmPAPb1     TAVPAEPASTLSGPSRPVTVAIGDRGHAVDLPDTDPRVQRRVTGWAPEQIAVALSASPTS
ZmPAPb2     -----EPASTLSGPSRPVTVAIGDRGHAVDLPDTDPRVQRRVTGWAPEQIAVALSASPTS
                 ******************************************:*********

ACR23335    AWVSWITGDYQMGGAVEPLDPGAVGSVVRYGLAADALDHEATGESLVYSQLYPFEGLQNY     120
ZmPAPb1     AWVSWITGDYQMGGAVEPLDPGAVGSVVRYGLAADALDHEATGESLVYSQLYPFEGLQNY
ZmPAPb2     AWVSWITGDYQMGGAVEPLDPGAVGSVVRYGLAADALDHEATGESLVYSQLYPFEGLQNY
            ************************************************************

ACR23335    TSGIIHHVRLQGLEPGTRYVYRCGDPAIPDAMSGVHAFRTMPAVGPGSYPGRIAVVGDLG     180
ZmPAPb1     TSGIIHHVRLQGLEPGTRYLYRCGDPAIPDAMSDVHAFRTMPAVGPGSYPGRIAVVGDLG
ZmPAPb2     TSGIIHHVRLQGLEPGTRYLYRCGDPAIPDAMSDVHAFRTMPAVGPGSYPGRIAVVGDLG
            *******************:*************.**************************

ACR23335    LTYNTTSTVDHLVRNRPDLVLLLGDVCYANLYLTNGTGADCYSCAFAKSTPIHETYQPRW     240
ZmPAPb1     LTYNTTSTVDHLVRNRPDLVLLLGDVCYANLYLTNGTGADCYSCAFAKSTPIHETYQPRW
ZmPAPb2     LTYNTTSTVDHLVRNRPDLVLLLGDVCYANLYLTNGTGADCYSCAFAKSTPIHETYQPRW
            ************************************************************

ACR23335    DYWGRYMEPVTSSIPMMVVEGNHEIEQQIHNRTFAAYSSRFAFPSEESGSSSPFYYSFDA     300
ZmPAPb1     DYWGRYMEPVTSSIPMMVVEGNHEIEQQIHNRTFAAYSSRFAFPSEESGSSSPFYYSFDA
ZmPAPb2     DYWGRYMEPVTSSIPMMVVEGNHEIEQQIHNRTFAAYSSRFAFPSEESGSSSPFYYSFDA
            ************************************************************

ACR23335    GGIHFVMLASYADYSRSGAQYKWLEADLEKVDRSVTPWLIAGWHAPWYTTYKAHYREAEC     360
ZmPAPb1     GGIHFVMLASYADYSRSGAQYKWLEADLEKVDRSVTPWLIAGWHAPWYTTYKAHYREAEC
ZmPAPb2     GGIHFVMLASYADYSRSGAQYKWLEADLEKVDRSVTPWLIAGWHAPWYTTYKAHYREAEC
            ************************************************************

ACR23335    MRVEMEELLYAYGVDVVFTGHVHAYERSNRVFNYTLDACGPVHISVGDGGNREKMATAHA     420
ZmPAPb1     MRVEMEELLYAYGVDVVFTGHVHAYERSNRVFNYTLDACGPVHISVGDGGNREKMATAHA
ZmPAPb2     MRVEMEELLYAYGVDVVFTGHVHAYERSNRVFNYTLDACGPVHISVGDGGNREKMATAHA
            ************************************************************

ACR23335    DEAGHCPDPASTPDPFMGGRLCAANFTSGPAAGRFCWDRQPEYSAYRESSFGHGVLEVRN     480
ZmPAPb1     DEAGHCPDPASTPDPFMGGRLCAANFTSGPAAGRFCWDRQPEYSAYRESSFGHGVLEVRN
ZmPAPb2     DEAGHCPDPASTPDPFMGGRLCAANFTSGPAAGRFCWDRQPEYSAYRESSFGHGVLEVRN
            ************************************************************

ACR23335    DTHALWRWHRNQDLHA---ANVAADEVYIVREPDKCLAKTARLLAY (SEQ ID NO: 116)
ZmPAPb1     DTHALWRWHRNQDLHAAAAANVAADEVYIVREPDKCLAKTARLLAY (SEQ ID NO: 12)
ZmPAPb2     DTHALWRWHRNQDLHAAAAANVAADEVYIVREPDKCLAKTARLLAY (SEQ ID NO: 14)
            ***************   ****************************
```

The amino acid sequence of *Zea mays* phytase ACR23335 were compared to the sequences of ZmPAPb1 and ZmPAPb2. The conserved residues D, Y, N, H, and H in the alignment are shown in bold and enlarged characters. The conserved region of ZmPAPb1 and ZmPAPb2 includes amino acid residues 173-383 and amino acids D178, D205, Y208, N262, 11263, 11344 and 11381.

CLUSTAL O(1.2.1) multiple sequence alignment of *Zea mays* phytases is shown below:

```
ZmPhy2      AGMTDLLMLTDKSQLQALAMLLRNNEELMMSQAIKSETERIEYLKTVSDCYTRTMKLLDD    60
AAB52233    AGMTDLLMLTDKSQLQALAMLLRNNEELMMSQAIKSETERVEYLKTVSDCYTRTMKLLDD
ZmPhy1      AGMTDLLMLTDKSQLQALAMLLRNNEELMMSQAIKSETERVEYLKTVSDCYTRTMKLLDD
            ************************************:***********************

ZmPhy2      SMAARTTYERSGGTRSLVARDMDDYVVYGLNACLQNVRNCCVRLDAIDKLRAHYDALADA   120
AAB52233    SMAARITYERSGGTRSLVARDMDDYVVYGLNACLQNVRNCCVRLDAIDKLRAHYDALADA
ZmPhy1      SMAARITYERSGGTRSLVARDMDDYVVYGLNACLQNVRNCCVRLDAIDKLRAHYDALADA
            ***** ******************************************************

ZmPhy2      VADPAANVEGLAAEASEYKAAMWQYCYNQRSASARAHSRAYSQALKLEGIDFAELVRRHQ   180
AAB52233    VAEPAANVEGLAAEASEYKAAMWQYCYNQRSASARAHSRAYSQALKLEGIDFAELVRRHQ
ZmPhy1      VAEPAANVEGLAAEASEYKAAMWQYCYNQRSASARAHSRAYSQALKLEGIDFAELVRRHQ
            **:*********************************************************

ZmPhy2      LRLGYGSKGEEFEDLDDTQKLEVYKQHHRRVGAGRGLPVRMFSSGRSAGGPKIAATTWAE   240
AAB52233    LRLGYGSKGEEFEDLDDTQKLEVYNSIIVESG-RAGLPVRMFSSGRSAGGPKIAATTWAQ
ZmPhy1      LRLGYGSKGEEFEDLDDTQKLEVYNSIIVESG-RAGLPVRMFSSGRSAGGPKIAATTWAQ
            ************************:.    . * **********************:

ZmPhy2      AVSVFIMAAGNLAWDVFTTEHEVEAILKGSLNLLAGLGGFAVEAVVGAAVTKAVANVGAG   300
AAB52233    AVSVFIMAAGNLAWDVFTTEHEVEAILKGSLNLLAGLGGFAVEAVVGAAVTKAVANVAAG
ZmPhy1      AVSVFIMAAGNLAWDVFTTEHEVEAILKGSLNLLAGLGGFAVEAVVGAAVTKAVANVGAG
            ********************************************************.**

ZmPhy2      VFACSLAGFVVGAIAGLIFVGVSGLLINLIIGSPRKVPDMSKLMFHTAVMPDGMALAYAV   360
AAB52233    VFACSLAGFVVGAIAGLIFVGVSGLLINLIIGSPRKVPDMSKLMFHTAVMPDGMALAYAV
ZmPhy1      VFACSLAGFVVGAIAGLIFVGISGLLINLIIGSPRKVPDMSKLMFHTAVMPDGMALAYAV
            *********************:**************************************

ZmPhy2      SH (SEQ ID NO: 28)
AAB52233    SH (SEQ ID NO: 117)
ZmPhy1      SH (SEQ ID NO: 26)
            **
```

The amino acid sequence of *Zea mays* phytase AAB52233 were compared to the sequences of ZmPhy1 and ZmPhy2. The conserved residues R and H in the alignment are shown in bold and enlarged characters. The conserved region of ZmPhy1 and ZmPhy2 includes amino acid residues 170-202 and residues R178, 11719, and R182. The residues that interact with the substrate are underligned.

E. coli-Derived Phytase Expression Vectors

TABLE 3

Expression Cassettes in Constructs for Expression in Seed

| Expression cassette* | SEQ ID NO | Promoter | Signal peptide | Coding sequence | C-terminal extension | Terminator |
|---|---|---|---|---|---|---|
| pAG4728 | 54 | Maize oleosin 16 | Maize gamma zein 27 | Phy-02 | SEKDEL (SEQ ID NO: 32) | NOS |
| pAG4813 | 55 | Maize oleosin 16 | Maize gamma zein 27 | Phy-02 | HvVSD | NOS |
| pAG4729 | 56 | Maize oleosin 16 | Maize gamma zein 27 | Phy-03 | SEKDEL (SEQ ID NO: 32) | NOS |
| pAG4814 | 57 | Maize oleosin 16 | Maize gamma zein 27 | Phy-03 | HvVSD | NOS |
| pAG4718 | 58 | Maize oleosin 16 | Maize gamma zein 27 | PhyNov9X | SEKDEL (SEQ ID NO: 32) | NOS |
| pAG4263 | 59 | Maize gamma zein 27 | Maize gamma zein 27 | Phy-02 | SEKDEL (SEQ ID NO: 32) | NOS |
| pAG4284 | 61 | Maize gamma zein 27 | Maize gamma zein 27 | Phy-02 | HvVSD | NOS |
| pAG4913 | 62 | Maize gamma zein 27 | Maize gamma zein 27 | Phy-02opt | SEKDEL (SEQ ID NO: 32) | NOS |
| pAG4265 | 63 | Maize gamma zein 27 | Maize gamma zein 27 | Phy-03 | SEKDEL (SEQ ID NO: 32) | NOS |
| pAG4285 | 65 | Maize gamma zein 27 | Maize gamma zein 27 | Phy-03 | HvVSD | NOS |
| pAG4259 | 66 | Maize gamma zein 27 | Maize gamma zein 27 | PhyNov9X | SEKDEL (SEQ ID NO: 32) | NOS |
| pAG4292 | 67 | Maize gamma zein 27 | Maize gamma zein 27 | PhyQB | SEKDEL (SEQ ID NO: 32) | NOS |

TABLE 3-continued

Expression Cassettes in Constructs for Expression in Seed

| Expression cassette* | SEQ ID NO | Promoter | Signal peptide | Coding sequence | C-terminal extension | Terminator |
|---|---|---|---|---|---|---|
| pAG4726 | 68 | Rice glutelin 1 | Maize gamma zein 27 | Phy-02 | SEKDEL (SEQ ID NO: 32) | CaMV 35s |
| pAG4799 | 69 | Rice glutelin 1 | Maize gamma zein 27 | Phy-02 | HvVSD | CaMV 35s |
| pAG4912 | 70 | Rice glutelin 1 | Maize gamma zein 27 | Phy-02opt | SEKDEL (SEQ ID NO: 32) | CaMV 35s |
| pAG4727 | 71 | Rice glutelin 1 | Maize gamma zein 27 | Phy-03 | SEKDEL (SEQ ID NO: 32) | CaMV 35s |
| pAG4801 | 72 | Rice glutelin 1 | Maize gamma zein 27 | Phy-03 | HvVSD | CaMV 35s |
| pAG4717 | 73 | Rice glutelin 1 | Maize gamma zein 27 | PhyNov9X | SEKDEL (SEQ ID NO: 32) | CaMV 35s |
| pAG4802 | 74 | Rice glutelin 1 | Maize gamma zein 27 | PhyNov9X | HvVSD | CaMV 35s |
| pAG4268 | 75 | Rice glutelin B4 | Maize gamma zein 27 | Phy-02 | SEKDEL (SEQ ID NO: 32) | NOS |
| pAG4294 | 76 | Rice glutelin B4 | Maize gamma zein 27 | Phy-02opt | SEKDEL (SEQ ID NO: 32) | NOS |
| pAG4269 | 77 | Rice glutelin B4 | Maize gamma zein 27 | Phy-03 | SEKDEL (SEQ ID NO: 32) | NOS |
| pAG4267 | 78 | Rice glutelin B4 | Maize gamma zein 27 | PhyNov9X | SEKDEL (SEQ ID NO: 32) | NOS |
| pAG4293 | 79 | Rice glutelin B4 | Maize gamma zein 27 | PhyQB | SEKDEL (SEQ ID NO: 32) | NOS |
| pAG4891 | 80 | Rice glutelin B4 | Rice glutelin B4 | Phy-02 | SEKDEL (SEQ ID NO: 32) | NOS |
| pAG4270 | 81 | Rice glutelin B4 | Rice glutelin B4 | PhyNov9X | SEKDEL (SEQ ID NO: 32) | NOS |
| pAG4260 | 142 | Maize globulin 1 | Maize gamma zein 27 | PhyNov9X | SEKDEL (SEQ ID NO: 32) | NOS |
| pAG4264 | 143 | Maize globulin 1 | Maize gamma zein 27 | Phy-02 | SEKDEL (SEQ ID NO: 32) | NOS |
| pAG4266 | 144 | Maize globulin 1 | Maize gamma zein 27 | Phy-03 | SEKDEL (SEQ ID NO: 32) | NOS |

*Expression cassettes are denoted by names of the transformation vectors that contained the cassettes.

TABLE 4

Two Cassettes Constructs for Expression in Seed

| Expression Cassette* | SEQ ID NO | Cassette # | Promoter | Signal peptide | Coding sequence | C-terminal extension | Terminator |
|---|---|---|---|---|---|---|---|
| pAG4915 | 60 | 1 | Rice glutelin 1 | Maize gamma zein 27 | Phy-02opt | SEKDEL | NOS |
|  |  | 2 | Rice glutelin 1 | Maize gamma zein 27 | Phy-02opt | SEKDEL | NOS |
| pAG4916 | 64 | 1 | Rice glutelin 1 | Maize gamma zein 27 | Phy-02opt | SEKDEL | NOS |
|  |  | 2 | Maize gamma zein 27 | Maize gamma zein 27 | Phy-02opt | SEKDEL | NOS |
| pAG4815 | 82 | 1 | Rice glutelin 1 | Maize gamma zein 27 | Phy-02 | SEKDEL | NOS |
|  |  | 2 | Maize oleosin 16 | Maize gamma zein 27 | Phy-02 | HvVSD | NOS |
| pAG4281 | 83 | 1 | Maize gamma zein 27 | Maize gamma zein 27 | Phy-02 | SEKDEL | NOS |
|  |  | 2 | Maize gamma zein 27 | Maize gamma zein 27 | Phy-02 | SEKDEL | NOS |
| pAG4892 | 84 | 1 | Maize gamma zein 27 | Maize gamma zein 27 | Phy-02 | SEKDEL | NOS |
|  |  | 2 | Rice glutelin B4 | Rice glutelin B4 | Phy-02 | SEKDEL | NOS |
| pAG4803 | 85 | 1 | Rice glutelin 1 | Maize gamma zein 27 | Phy-02 | HvVSD | NOS |
|  |  | 2 | Maize oleosin 16 | Maize gamma zein 27 | Phy-02 | SEKDEL | NOS |

TABLE 4-continued

Two Cassettes Constructs for Expression in Seed

| Expression Cassette* | SEQ ID NO | Cassette # | Promoter | Signal peptide | Coding sequence | C-terminal extension | Terminator |
|---|---|---|---|---|---|---|---|
| pAG4816 | 86 | 1 | Rice glutelin 1 | Maize gamma zein 27 | Phy-03 | SEKDEL | NOS |
|  |  | 2 | Maize oleosin 16 | Maize gamma zein 27 | Phy-03 | HvVSD | NOS |
| pAG4282 | 87 | 1 | Maize gamma zein 27 | Maize gamma zein 27 | Phy-03 | SEKDEL | NOS |
|  |  | 2 | Maize gamma zein 27 | Maize gamma zein 27 | Phy-03 | SEKDEL | NOS |
| pAG4810 | 88 | 1 | Rice glutelin 1 | Maize gamma zein 27 | Phy-03 | HvVSD | NOS |
|  |  | 2 | Maize oleosin 16 | Maize gamma zein 27 | Phy-03 | SEKDEL | NOS |
| pAG4798 | 89 | 1 | Maize gamma zein 27 | Maize gamma zein 27 | PhyNov9X | SEKDEL | NOS |
|  |  | 2 | Maize oleosin 16 | Maize gamma zein 27 | PhyNov9X | SEKDEL | NOS |
| pAG4797 | 90 | 1 | Rice glutelin 1 | Maize gamma zein 27 | PhyNov9X | SEKDEL | CaMV 35s |
|  |  | 2 | Maize oleosin 16 | Maize gamma zein 27 | PhyNov9X | SEKDEL | NOS |
| pAG4279 | 145 | 1 | Maize gamma zein 27 | Maize gamma zein 27 | Phy-02 | SEKDEL | NOS |
|  |  | 2 | Maize globulin 1 | Maize gamma zein 27 | Phy-02 | SEKDEL | NOS |
| pAG4811 | 146 | 1 | Rice glutelin 1 | Maize gamma zein 27 | Phy-02 | HvVSD | NOS |
|  |  | 2 | Maize globulin 1 | Maize gamma zein 27 | Phy-02 | SEKDEL | NOS |
| pAG4280 | 147 | 1 | Maize gamma zein 27 | Maize gamma zein 27 | Phy-03 | SEKDEL | NOS |
|  |  | 2 | Maize globulin 1 | Maize gamma zein 27 | Phy-03 | SEKDEL | NOS |
| pAG4812 | 148 | 1 | Rice glutelin 1 | Maize gamma zein 27 | Phy-03 | HvVSD | NOS |
|  |  | 2 | Maize globulin 1 | Maize gamma zein 27 | Phy-03 | SEKDEL | NOS |
| pAG4295 | 181 | 1 | Rice glutelin B4 | Maize gamma zein 27 | Phy-02opt | SEKDEL | NOS |
|  |  | 2 | Rice glutelin B4 | Maize gamma zein 27 | Phy-02opt | SEKDEL | NOS |

*Expression cassettes are denoted by names of the transformation vectors that contained the cassettes.

TABLE 5

Three Cassette Constructs for Expression in Seed

| Expression Cassette* | SEQ ID NO | Cassette # | Promoter | Signal peptide | Coding sequence | C-terminal extension | Terminator |
|---|---|---|---|---|---|---|---|
| pAG4821 | 91 | 1 | Maize gamma zein 27 | Maize gamma zein 27 | Phy-02 | SEKDEL (SEQ ID NO: 32) | NOS |
| | | 2 | Rice glutelin 1 | Maize gamma zein 27 | Phy-02 | HvVSD | NOS |
| | | 3 | Maize oleosin 16 | Maize gamma zein 27 | Phy-02 | SEKDEL (SEQ ID NO: 32) | NOS |
| pAG4822 | 92 | 1 | Maize gamma zein 27 | Maize gamma zein 27 | Phy-03 | SEKDEL (SEQ ID NO: 32) | NOS |
| | | 2 | Rice glutelin 1 | Maize gamma zein 27 | Phy-03 | HvVSD | NOS |
| | | 3 | Maize oleosin 16 | Maize gamma zein 27 | Phy-03 | SEKDEL (SEQ ID NO: 32) | NOS |
| pAG4758 | 149 | 1 | Rice glutelin 1 | Maize gamma zein 27 | Phy-02 | SEKDEL (SEQ ID NO: 32) | NOS |
| | | 2 | Maize gamma zein 27 | Maize gamma zein 27 | Phy-02 | SEKDEL (SEQ ID NO: 32) | NOS |
| | | 3 | Maize globulin 1 | Maize gamma zein 27 | Phy-02 | SEKDEL (SEQ ID NO: 32) | NOS |

TABLE 6

Expression Cassettes for Expression of E. coli-derived Phytases in Other Tissues, Including Leaves

| Expression Cassette* | SEQ ID NO | Promoter | Signal peptide | Coding sequence | C-terminal extension | Terminator |
|---|---|---|---|---|---|---|
| pAG4871 | 93 | Maize ubiquitin 1 | Maize gamma zein 27 | Phy-02 | SEKDEL (SEQ ID NO: 32) | NOS |
| pAG4868 | 94 | Maize PEP carboxylase | Maize gamma zein 27 | Phy-02 | SEKDEL (SEQ ID NO: 32) | NOS |
| pAG4872 | 95 | Maize ubiquitin 1 | Maize gamma zein 27 | Phy-03 | SEKDEL (SEQ ID NO: 32) | NOS |
| pAG4869 | 96 | Maize PEP carboxylase | Maize gamma zein 27 | Phy-03 | SEKDEL (SEQ ID NO: 32) | NOS |
| pAG4870 | 97 | Maize ubiquitin 1 | Maize gamma zein 27 | PhyNov9X | SEKDEL (SEQ ID NO: 32) | NOS |
| pAG4867 | 98 | Maize PEP carboxylase | Maize gamma zein 27 | PhyNov9X | SEKDEL (SEQ ID NO: 32) | NOS |

*Expression cassettes are denoted by names of the transformation vectors that contained the cassettes.

In comparing the E. coli phytases Nox9X, Phy02, Phy03, and QB, the standard conserved RHGXRXP (SEQ ID NO: 185) motif incorporates residues 16-22 of the wild-type sequence and is conserved amongst these molecules. In addition to these conserved residues, there are nine other residues that interact with the substrate, which are common among these enzymes, except for Q253, which is valine in QB only. The conserved region in E. coli phytases extends from amino acid residues 16 to 306 and include residues R16, H17, G18, R20, P22, T23, K24, D88, R92, S212, S215, M216, Q253 (which is V in QB), R267, H303, D304, and T305. There are also four disulfide bonds in the wild-type enzyme: C178-C188, C77-C108, C382-C392, and C133-C408. All of these cysteines are conserved except for C178 and C188 in Phy02. Nov9X also has cysteines in positions 76 and 205 (75 and 204 using wild-type numbering), but they are at opposite ends of the crystal structure so they aren't likely to form a disulfide. The 178-188 disulfide holds the ends of two helices together at one end of the molecule.

Sequences of Preferred Expression Constructs.

FIG. 1 illustrates tandem expression cassettes for Phy02 in vector pAG4281 (SEQ ID NO: 37). Each one of the expression cassettes includes ZmZ27P, promoter from the maize gamma zein Z27 gene; Z27ss, signal peptide from maize gamma zein 27; Phy-02, coding sequence for phytase Phy-02; SEKDEL (SEQ ID NO: 32), hexapeptide C-terminal signal sequence for retention in the endoplasmic reticulum; NOS, nopaline synthase polyadenylation sequence.

Example 2. Expression of Phytase in Transgenic Plants

Independently transgenic or, in the case of maize plants made with additional plant-derived phytase molecules, cisgenic, maize plants that had been transformed with vectors, or had expression cassettes directly introduced using various genome editing technologies (including meganucleases, zinc finger proteases, the CRISPR-Cas system, or related systems), as described above were grown to maturity, and cross-pollinated with wild-type (untransformed) maize plants. Approximately 20 seed were harvested from each of these plants. Seed was milled through a 0.5 mm screen to produce a fine powder. Enzyme was then extracted and assayed for phytase activity as described below.

Phytase Assay from Seed.

Enzyme extracts were prepared by incubating 15 mg milled seed flour for 1 hour at room temperature in 1.5 ml of 25 mM sodium borate, pH 10, 0.01% Tween 20. Extracts were then diluted 100-fold in an assay buffer (250 mM sodium acetate, pH 5.5, 1 mM calcium chloride, 0.01% Tween 20). Seventy five microliters of the diluted extracts or 75 ml of buffer-only controls were dispensed into individual wells of a round-bottom 96-well plate. One hundred fifty microliters of freshly-prepared phytic acid (9.1 mM dodecasodium salt from Biosynth International, Staad, Switzerland, prepared in assay buffer) were added to each well. Plates were sealed and incubated for 60 min at 37° C. One hundred fifty microliters of the stop solution (20 mM ammonium molybdate, 5 mM ammonium vanadate, 4% nitric acid) was added to each well, mixed thoroughly via pipetting, and allowed to incubate at room temperature for 10 minutes. Plates were centrifuged at 3000×G for 10 minutes, and 100 µL of the clarified supernatants were transferred to the wells of a flat-bottom 96-well plate. Absorbance at 415 nm from each sample was compared to that of negative controls (buffer-only, no enzyme) and potassium phosphate standards. The standard curve was prepared by mixing 50 µl of potassium phosphate standards (0-1.44 mM, prepared in assay buffer) with 100 µL of freshly-prepared phytic acid, followed by 100 mL of stop solution.

Phytase activity varied significantly in seed from independent transgenic plants, as expected. Seed were harvested from the initial transformants (T0) that had been systematically generated with the construct pAG4758 that includes three expression cassettes: OsGlu1:mZ27:Phy-02:SEKDEL mZein:mZ27:Phy-02:SEKDEL, and Glb1:mZ27:Phy-02:SEKDEL.

Seed were then tested for expression of the transgenes via phytase enzyme assays. Activities observed among 83 transformants varied with the highest expressors having activities up to 2976 FTU/g. Furthermore, segregation analysis among seed derived from these events determined that some of the highest expressing events carried T-DNAs inserted into multiple chromosomes. Based on these observations, two of the events were selected for further propagation. The hemizygous phytase activity that was measured in these two events is shown in Table 7.

TABLE 7

Phytase Activity as Measured in Seed Harvested From Initial Transformants (T0) of Two Lead Events

| Event | FTU/g |
| --- | --- |
| 4758_15* | 1523 ± 79 |
| 4758_203** | 2601 ± 144 |

*4758_15 corresponds to event PY15
**4758_203 corresponds to event PY203

Figure 2:
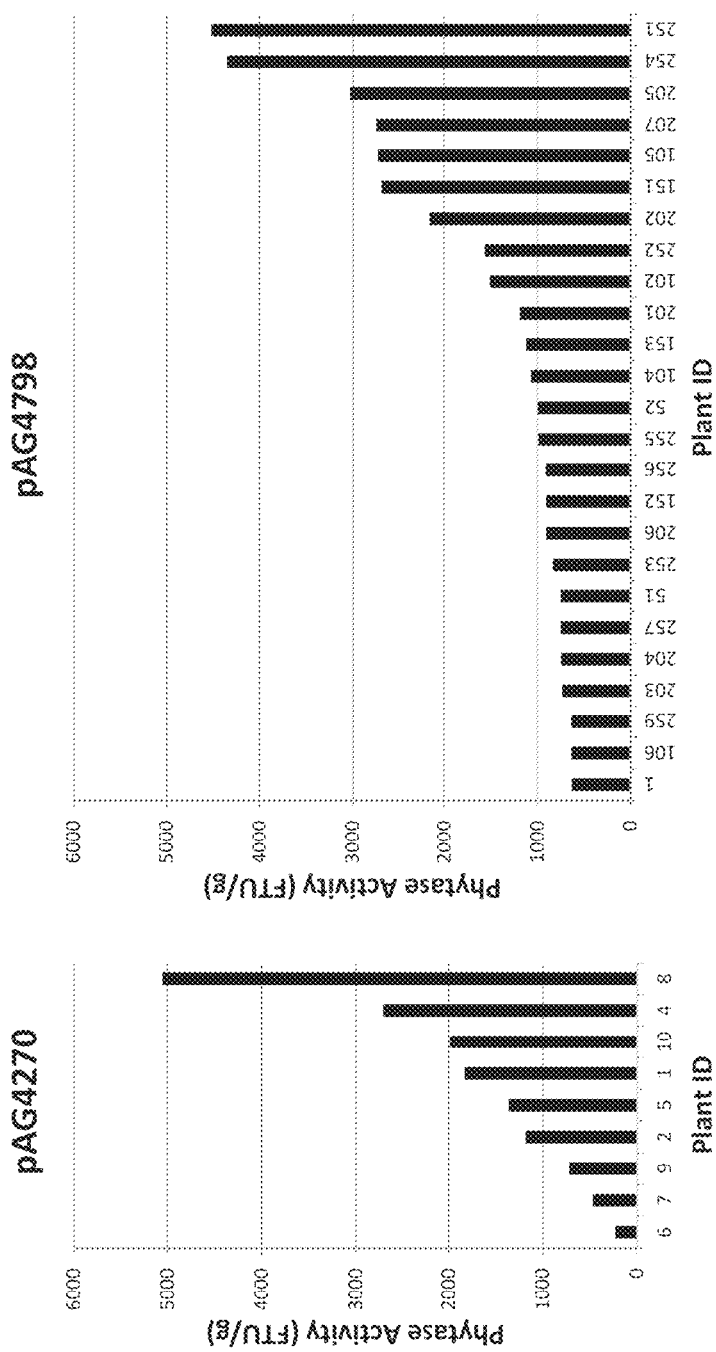
FIG. 2 illustrates the range of Nov9X activity that was observed in the grains of the transgenic plants that had been generated with the expression vectors pAG4270 and pAG4798.

FIG. 2 illustrates the range of Nov9X activity that was observed among transgenic plants that had been generated with the expression vectors pAG4270 and pAG4798. Referring to FIG. 2, the phytase activity was detectable in grain from independently-transformed transgenic maize plants expressing Nov9X. Plant IDs are arbitrary numerical tags assigned to individual plants for the purpose of tracking the corresponding plants and their progeny.

Figure 3:
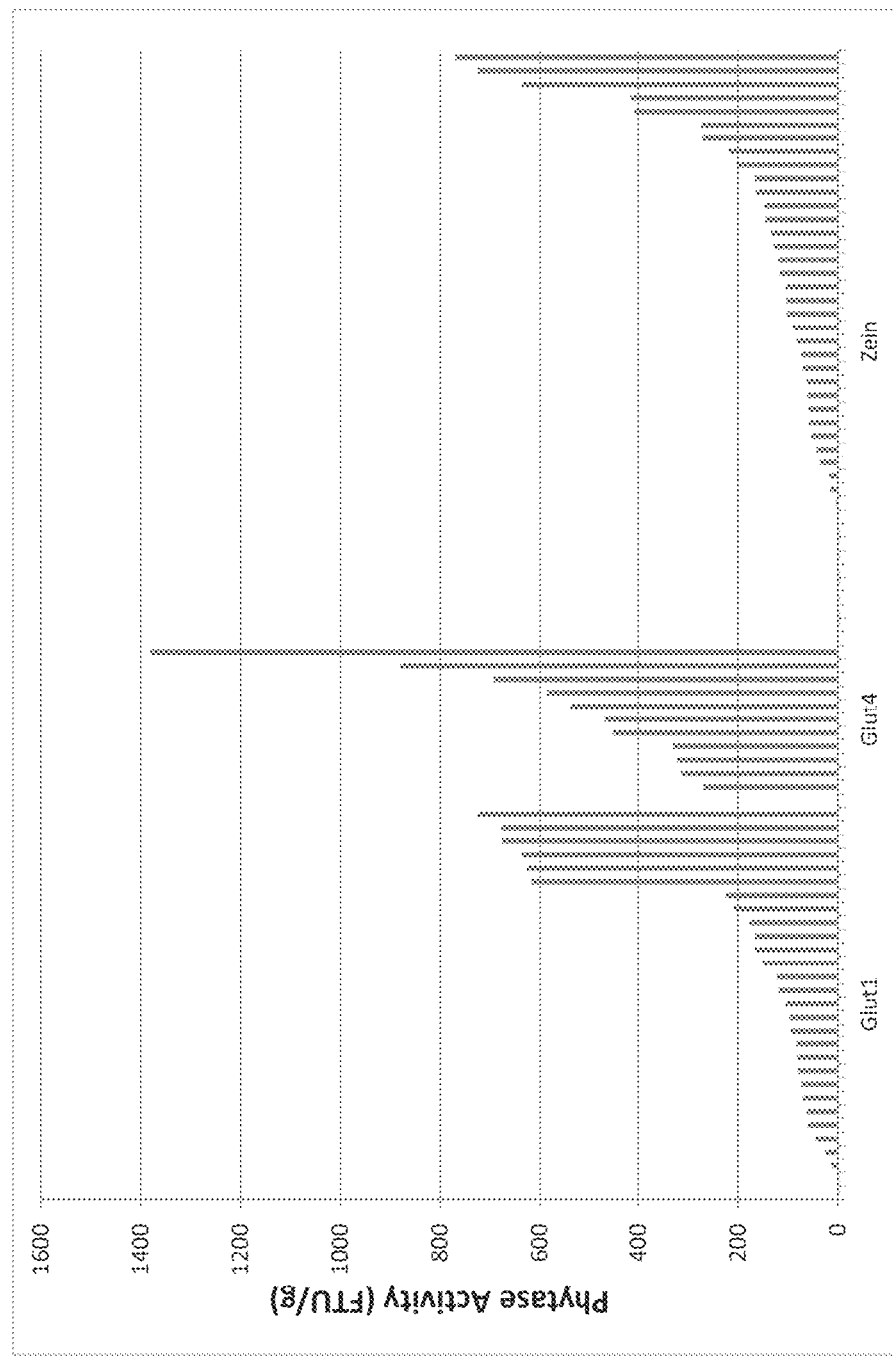
FIG. 3 illustrates examples of phytase expression levels detected in seed when Phy03 expression is driven by one of three different promoters: Glut1, rice glutelin 1 promoter; Glut4, rice glutelin B4 promoter; Zein, maize gamma zein 27 promoter.

Seed was similarly harvested from multiple, independently-generated transgenic plants that expressed Phy03. Examples of Phy03 expression that was observed in these seed are shown in FIG. 3. FIG. 3 illustrates examples of phytase expression levels detected in seed when Phy03 expression is driven by one of three different promoters. In FIG. 3, Glut1 refers to rice glutelin 1 promoter (SEQ ID NO: 5); Glut4 refers to rice glutelin B4 promoter (SEQ ID NO: 6); and Zein refers to maize gamma zein 27 promoter (SEQ ID NO: 4). Each bar corresponds to the phytase activity that was detected in the pooled seed from a single transgenic plant. In some cases, the phytase activity that was measured was below detectable limits.

These plants had been transformed with the following expression vectors: pAG4727, carrying the Rice glutelin 1 promoter; pAG4269, carrying the Rice glutelin B4 promoter; and pAG4265, carrying the Maize gamma zein 27 promoter. In this plot, the effectiveness of the three different promoters can be compared. A greater percentage of plants with relatively high levels of expression were recovered among plants that had been transformed with pAG4269, which incorporates the rice glutelin B4 promoter. Similarly, a greater percentage of plants with intermediate or high levels of Phy03 activity were recovered among plants that had been transformed with vectors pAG4727 and pAG4265, which incorporate the rice glutelin 1 and maize gamma zein 27 promoters, respectively.

Example 3. Genetic Characterization of Preferred Transgenic Plants

Transgenic maize plants were selected for further characterization.

Two plants had been generated via transformation with the vector pAG4758 having three expression cassettes: mZein:mZ27:Phy-02:SEKDEL, Glb1:mZ27:Phy-02:SEKDEL, Glu1:mZ27:Phy-02:SEKDEL. These events were identified as PY203 and PY15. Genomic DNA was isolated from each of these plants and subjected to sequence analysis.

PY15:

Genetic and sequence analysis of this insertion event revealed that three partial (truncated) T-DNAs are inserted into a single locus in the maize genome. The PY15 insertion (32132 nucleotides [nts]) and its flanking genomic DNA (6407 nts) were isolated using PCR-based approaches. The PY15 insertion contains three partial T-DNA repeats from the construct pAG4758 adjacent to one another and is inserted into maize chromosome 5.

Analysis of the genomic flanks maps the PY15 insertion at a non-genic region of maize chromosome 5. The nearest predicted maize gene is more than 20 kb from the T-DNA insertion site.

Genomic DNA near the T-DNA left border and right border was named left flank (LF) and right flank (RF), respectively. A single HindIII fragment of 6435 nts from the B line maize genomic DNA contains both the LF and RF. LF has 2915 nts (SEQ ID NO: 44) and RF has 3492 nts (SEQ ID NO: 45). A GenBank database search using both LF and RF sequences hit multiple targets from B73 maize chromosome 5, which serves as the reference genome.

The total length of maize B73 chromosome 5 is 217928451 bp (B73 RefGen_v3, sequence ID: NC 024463.1). In chromosome 5, the T-DNA appears to be inserted in the region of the maize genome that includes the sequence of SEQ ID NO: 41 (chromosome 5 excerpt (B line PY_15 locus sequence). The PY_15 locus misses 28 nucleotides ATGGGGAAAGTCGCCCCGCCGATAGCGA (SEQ ID NO: 150) located between nucleotides 2915 and 2944 of SEQ ID NO: 41.

The right most nucleotide of the LF of SEQ ID NO: 41 corresponds to position 186821053 and the left most nucleotide of the RF of SEQ ID NO: 41 corresponds to position 186821082 of the annotated maize B73 chromosome 5. The 28 nucleotides gap between the LF and RF is missing in PY15 but present in both B and B73 maize lines, suggesting that the PY15 T-DNA insertion creates a 28 nucleotide deletion in the maize genome at the insertion site. The PY15 insertion and the 28 nucleotide deletion caused by this insertion are believed to have no impact on maize genes, because there is no experimental or hypothetical gene at the insertion site.

The sequence of the PY15 locus from the maize (SEQ ID NO: 125) is a 38539 nucleotide sequence that includes the LF border (1-2915 nts), T-DNA and RF border (35048-38539 nts) sequences. T-DNA sequences is a 32412 nucleotides sequence (SEQ ID NO: 151) located between nucleotides in positions 2915 and 35048 in SEQ ID NO: 125.

PY203:

An analysis of the T-DNA in PY203 revealed the presence of two separate insertion sites. One T-DNA is inserted into chromosome 8 ("Locus 3293") and a second T-DNA is inserted into chromosome 2 ("Locus 3507"). Locus 3293 contains a single T-DNA. Locus 3507 contains a single, truncated T-DNA, which includes only 2 of the three phytase expression cassettes. In Locus 3293, the inserted sequence begins in the region that corresponds to the Right Border sequence of the T-DNA, through the three expression cassettes for Phy02, through the expression cassette for the PMI selectable marker, and to the Left Border sequence of the T-DNA from the vector. In Locus 3507, the inserted sequence ("GTGTGAGGCGC" (SEQ ID NO: 38)) begins in the region that corresponds to the Right Border sequence and continues through to nucleotides of the vector and has nucleotide coordinates 10530-10540 8144. The host sequences flanking the insertions in both chromosome 8 ("Locus 3293") and chromosome 2 ("Locus 3507") appear to be intact.

In chromosome 8, the T-DNA appears to be inserted in the region of the maize genome that includes the sequence of SEQ ID NO: 39 (Chromosome 8 excerpt).

In chromosome 2, the partial T-DNA appears to be inserted in the region of the maize genome that includes the sequence of SEQ ID NO: 40 (Chromosome 2 excerpt).

Sequence Characterization of T-DNA Insertion Loci 3293 and 3507 in the Maize Transgenic Event PY203

Locus 3293:

Using a combination of genome walking and various PCR amplification strategies, the entire locus 3293 in the event PY203 has been isolated and sequence characterized together with the flanking maize genomic DNA sequences isolated from both sides of the T-DNA insertion. The final 3293 locus sequence of 18621 bp (SEQ ID NO: 42) contains single and intact copy of the T-DNA (SEQ ID NO: 152) of the pAG4758 construct with the nucleotide coordinates 17223-11173 of the vector. There are no integrated vector backbone sequences in PY203. At its right border side the T-DNA is flanked by 1812 bp of the maize genomic DNA (1-1812 nts of SEQ ID NO: 42) that is according to the BLASTN results against publicly available B73 maize genome sequence database has 100% identity a sequence on the maize chromosome 8 (nucleotide position: 89933570-89935378) (Lawrence et al., 2004, Nucleic Acids Research 32: D393-D397, which is incorporated herein by reference as if fully set forth). This genomic region does not have any currently annotated genes or genetic elements. Furthermore, the T-DNA insertion in locus 3293 of the event PY203 did not create any new open reading frames that would span the junction between the isolated 1812 bp maize genomic DNA and the 5' end of the inserted vector T-DNA.

At its left border side, a 1662 bp maize genomic DNA (16960-18621 of SEQ ID NO: 42) was identified, which is attached to the processed left T-DNA border sequence at the nucleotide position 11173 in the vector. The 1662 bp maize genomic DNA sequence was identified on the maize chromosome 8 (nucleotide position: 89935403-89937064).

The integrated locus 3293 contains an intact copy of the T-DNA (15147 nts; SEQ ID NO: 152) of the transformation vector, which has displaced 24 nucleotides of the original maize genomic DNA sequence on the maize chromosome 2. The T-DNA sequence is located in the sequence of SEQ ID NO: 42 between nucleotides 1812 and 16960.

Locus 3507:

Similarly to the work performed on the locus 3293, genome walking and various PCR amplification approaches led to isolation and sequence characterization of the entire locus 3507 in the event PY203, including flanking maize genomic DNA sequences at the both ends of the T-DNA. The locus 3507 specific sequence of 13109 bp (SEQ ID NO: 43) contains single, but truncated at its 3' end T-DNA copy. There are no integrated vector backbone sequences at this T-DNA integration site.

The 2101 bp maize genomic DNA flank (nts 1-2101 of SEQ ID NO: 43) identified at the 5' end of the T-DNA (right border side) in the locus 3507 has 100% sequence identity to the nucleotides 141216135-141214035 of the maize chromosome 2 in B73 maize genome sequence database. A 2569 bp maize genomic DNA (nts 10543-13110 of SEQ ID NO: 43) was identified that is attached to the truncated 3' end of the T-DNA and has 99.96% sequence identity to nucleotides 141213994-141211426 of the maize chromosome 2 in the B73 genome.

Thus, T-DNA of the vector (8439 nts; SEQ ID NO: 153) that is integrated into locus 3507 has displaced 40 nucleotides of the original maize genomic DNA sequence on maize chromosome 2. The T-DNA sequence is located between nts 2101 and 10541 of SEQ ID NO: 43. There are no annotated genes in the vicinity of the T-DNA insertion at the locus 3507 according to information on publicly available maize genome sequence reference B73.

Sequence Characterization of T-DNA Insertion Locus in the Transgenic Maize Event PY53 (4281_53)

Event PY53 had been generated via transformation with the vector pAG4281 that includes two expression cassettes: ZmGammaZein27: ZmGammaZein27:Phy-02:SEKDEL: NOS and ZmGammaZein27:ZmGammaZein27: Phy-02: SEKDEL:NOS.

Using a combination of genome walking and various PCR-based amplification strategies, the entire PY53 locus sequence in the event 4281_53 has been isolated as a series of overlapping PCR or restriction fragments. The fragments were cloned and multiple individual clones were completely sequenced in both directions, including the flanking maize genomic DNA sequences isolated at both ends of the T-DNA insertion. It was determined that the 41,344 bp PY53 locus sequence (SEQ ID NO: 175) contains three complete copies of T-DNA, which originates from the vector pAG4281, as well as one partial T-DNA copy that lacks the PMI marker gene expression cassette.

The genetic organization of the PY53 locus is arranged with T-DNAs being either tandem or inverted repeats. The locus contains eight intact and potentially fully functional Phy02 expression units. There were no integrated vector backbone sequences detected at this T-DNA integration site or in the maize genome of the 4281_53 transgenic event. No known annotated gene sequences in the proximity of T-DNA insertion site in the PY53 locus were found based on analysis of the publicly available reference sequence of the B73 maize genome (Maize B73 RefGen_v4). The insertion of the pAG4281 T-DNAs into the maize genome of the event 4281_53 has displaced 34 nucleotides of the original wild type maize genomic DNA on the maize chromosome 6 and has occurred between nucleotides with coordinates 142266564-142266598.

On the right border side, the PY53 locus is flanked by the isolated and sequence characterized 4,222 bp of the maize genomic DNA flanking sequence. This DNA maps with 100% sequence identity to a sequence on the maize chromosome 6 (nucleotide position: 142266564-142262343).

On the left border side, the locus PY53 is flanked by the isolated and sequence characterized 1,948 bp of the maize genomic DNA that, according to the BLASTN results against publicly available B73 maize genome sequence database (Maize B73 RefGen_v4), has 100% identity to a sequence on the maize chromosome 6 (nucleotide position: 142268545-142266598). It appears that this maize genomic region does not have any annotated genes or known genetic elements. At the left T-DNA border site of the locus PY53, the T-DNA insertion did not create any new open reading frames that would span the junction between the isolated 1,948 bp maize genomic DNA left border flank and the 3' end of the inserted pAG4281 T-DNA.

PY209:

Genetic and sequence analysis of this insertion event revealed that a single 9,968 bp T-DNA sequence (SEQ ID NO: 155) from pAG4295 vector (nucleotides 12756-6696) is inserted into a single locus in the maize genome on chromosome 4. The PY209 insertion and its flanking genomic DNA were isolated using PCR-based approaches. Genomic DNA near the T-DNA left border and right border was named left flank (LF) and right flank (RF), respectively. The PY209 locus is a 13592 nucleotides sequence of SEQ ID NO: 154 and includes RF, T-DNA and LF sequences. The T-DNA sequence is located between nucleotides 1848 and 11817 of SEQ ID NO: 154.

RF includes 1,848 bp maize genomic DNA (nts 1-1,848 of SEQ ID NO: 154) that side with the nucleotide coordinates 227649299-227648250 on the chromosome 4, and LF includes 1,776 bp maize genomic DNA (11817-13592 nts of SEQ ID NO: 154) that side with the nucleotide coordinates 227648225-227646448.

PY1053:

(4915_1053) Genetic and sequence analysis of this insertion event identified right border flank (2314 nts; SEQ ID NO: 156) and left border flank (2248 nts; SEQ ID NO: 157) sequences. RB flank includes 1,802 nucleotides of maize genomic DNA and a portion of T-DNA (nucleotides 1804-2314 of SEQ ID NO: 156).

LB flank includes a portion of T-DNA sequence (1-505 nucleotides of SEQ ID NO: 157), and 1,742 nucleotides of maize genomic DNA (506-2248 nts of SEQ ID NO: 157).

PY1203 (4916_1203):

Genetic and sequence analysis of this insertion event identified right border flank (2314 nts; SEQ ID NO: 158) and left border flank (2252 nts; SEQ ID NO: 159) sequences.

RB flank includes 1,868 nucleotides of maize genomic DNA and a portion of T-DNA (nucleotides 1869-2314 of SEQ ID NO: 158).

LB flank includes a portion of T-DNA sequence (1-494 nucleotides of SEQ ID NO: 159), and 1,758 nucleotides of maize genomic DNA (495-2252 nts of SEQ ID NO: 159) from chromosome 10 (130103639-130101882). Based on the flanking sequence information, these events are expected to carry at least two T-DNAs, which have integrated into maize genome with a head-to-head orientation pattern.

Example 4. Properties of the Phytases pH Optimum of the Phytases.

Figure 4:
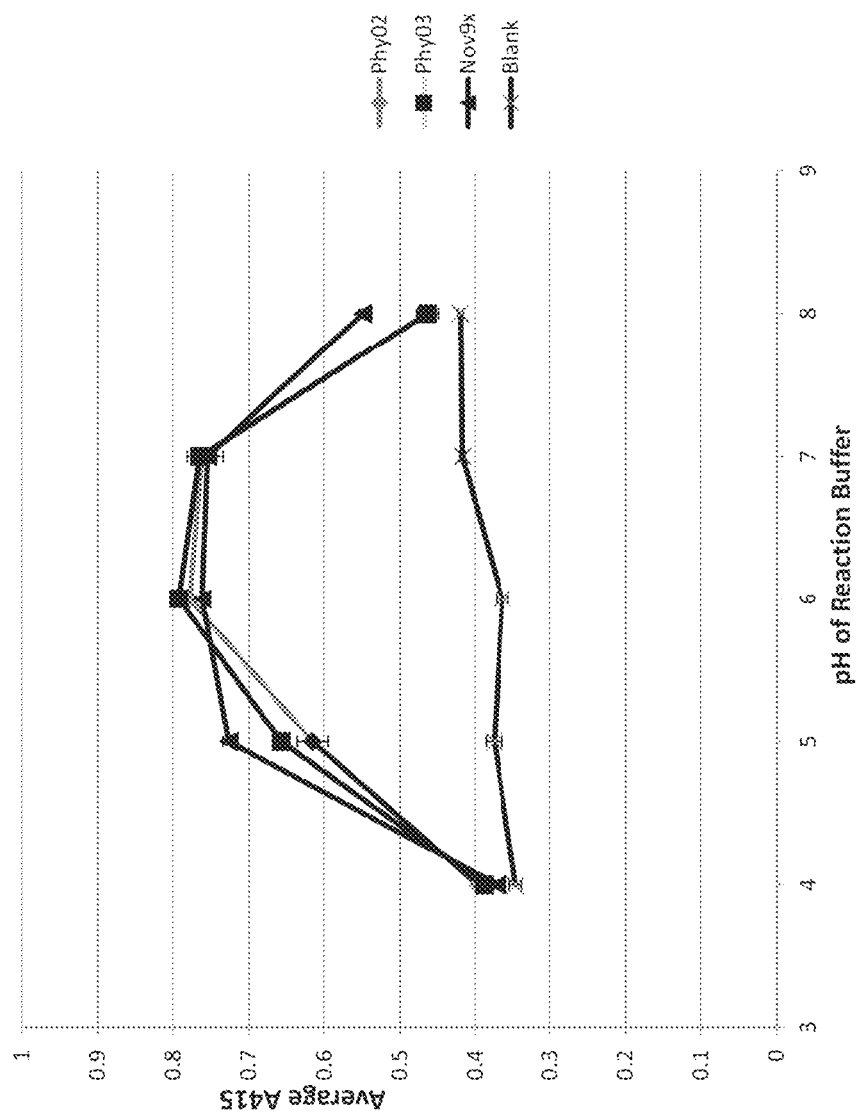
FIG. 4 illustrates pH optima of phytases.

Enzymes were extracted from cultures of *E. coli* that expressed either recombinant Phy02, Phy03 or Nov9X phytase. 10 nM dilutions of these enzymes were then assayed as described above, except that the assay buffer was switched from 250 mM sodium acetate, to an alternative "CCH polybuffer," which pH could be adjusted to several different values. A 10× stock of the CCH polybuffer containing 222 mM anhydrous citric acid, 333 mM HEPES, and 444 mM CHES was prepared. Stocks were then diluted and their pH adjusted with sodium hydroxide, as needed, to obtain 1× stocks at various pH. These 1× stocks were then used in place of the sodium acetate assay buffer in the phytase assay, and the detectable activity recorded as the absorbance at 415 nm. FIG. 4 illustrates pH optima of phytases. As shown in 4, each of the phytases tested had a pH optimum near pH 6.

Enzyme Kinetics.

Determination of kinetic properties of the phytases, based upon the estimation of inorganic phosphate released on hydrolysis of phytic acid, was performed following the method described by Engelen et al. (Engelen et al., 2001) with modifications. Phytase at a final concentration of 1 nM was incubated in a microplate with various concentrations of phytic acid in 250 mM sodium acetate, 1 mM calcium chloride, and 0.01% (v/v) Tween-20, pH 5.5 in a total volume of 150 µL. After incubation for 30 minutes at 37° C., reactions were stopped by adding 100 µL of a color-stop reagent consisting of 2.5% (w/v) ammonium molybdate, 0.059% (w/v) ammonium vanadate, and 5.8% (v/v) nitric acid (made fresh from stock solutions of each component). The samples were allowed to sit at room temperature for 10 minutes, followed by centrifugation at 3000×g for 10 minutes. Aliquots of 100 µL supernatant were transferred to a microplate, and phosphate release was measured against a set of phosphate standards spectrophotometrically at 415 nm. Data was fit to the Michaelis-Menton equation using Microsoft Excel. Nov9X, Phy02 and Phy03 were purified from recombinant *E. coli*. Commercial phytase (CP) was purified from commercially available samples. SDS-PAGE gel revealed two predominant species in CP, which differed slightly in their apparent molecular weights. Each of these species (the "upper band" and the "lower band") was purified and assayed separately. The kinetic properties of the phytases are shown in Table 8.

TABLE 8

Enzyme Kinetics

|  | Nov9X | Phy02 | Phy03 | CP (upper band) | CP (lower band) |
| --- | --- | --- | --- | --- | --- |
| $k_{cat}$ (turnover/s) | 767 | 549 | 642 | 261 | 244 |
| $k_M$ (mM) | 0.789 | 0.515 | 0.680 | 0.494 | 0.357 |
| $k_{cat}/k_M$ | 972 | 1065 | 944 | 529 | 683 |
| $\chi^2$ | 11834 | 9617 | 6785 | 192 | 402 |

Gastric Stability of Enzymes.

Figure 5:
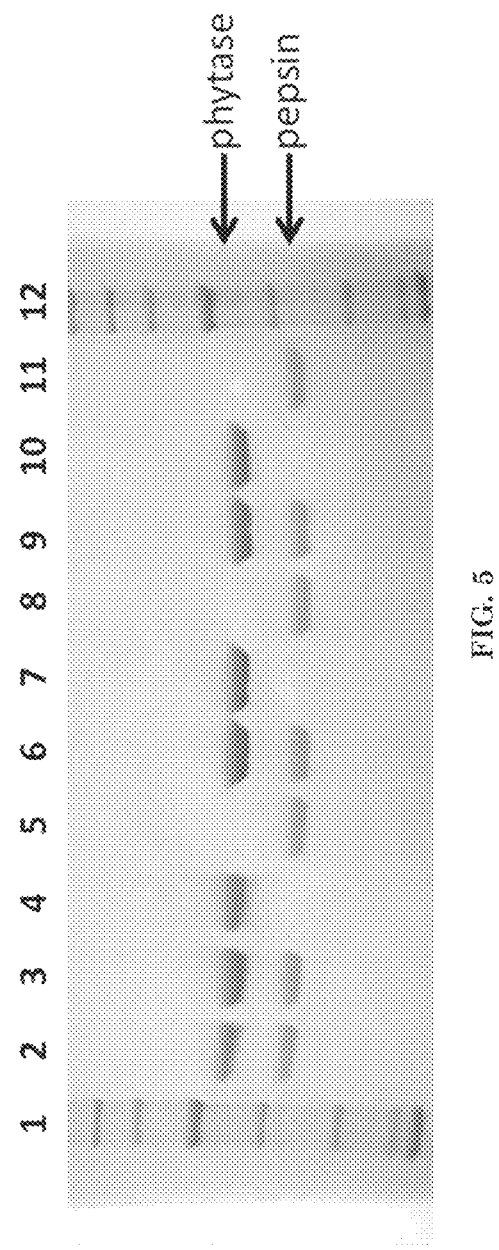
FIG. 5 illustrates gastric stability of modified phytases.

Gastric lability of a recombinant protein is one factor that the United States Department of Agriculture considers when contemplating to permit broad acre propagation of crops that produce that protein. To determine how each enzyme might persist in the digestive tract, specifically as it passes through the stomach, enzymes were purified and subjected to a standardized assay for sensitivity to simulated gastric fluid (Thomas et al., 2004). FIG. 5 illustrates gastric stability of modified phytases. Referring to this figure, lane 1 shows Benchmark molecular weight marker; lane 2 shows Nov 9x (10 min, with pepsin); lane 3 shows Nov 9x (0 min, with inactivated pepsin); lane 4 shows Nov 9x (no pepsin); lane 5 shows Phy02 (10 min, with pepsin); lane 6 shows Phy02 (0 min, with inactivated pepsin); lane 7 shows Phy02 (no pepsin); lane 8 shows Phy03 (10 min, with pepsin); lane 9 shows Phy03 (0 min, with inactivated pepsin); lane 10 shows Phy03 (no pepsin); lane 11 shows D (pepsin only); and lane 12 shows Benchmark molecular weight marker. Referring to FIG. 5, it was observed that whereas Nov9X was relatively stable in the presence of simulated gastric fluid (lane 2), both Phy02 and Phy03 are readily digested by pepsin (lanes 5 and 8, respectively).

Figure 6:
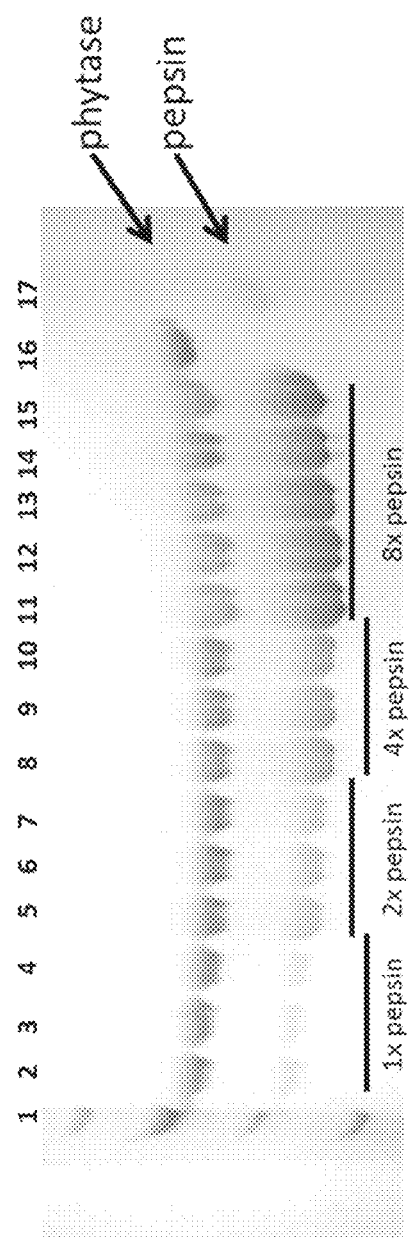
FIG. 6 illustrates gastric stability of commercial phytase.

FIG. 6 illustrates gastric stability of commercial phytase (CP). The amount of pepsin and the incubation time in the digestion assay were varied to determine whether the enzyme might be susceptible under more stringent conditions. Referring to FIG. 6, lane 1 shows BenchMark molecular weight marker; lane 2 shows CP (1 h, 1× pepsin); lane 3 shows CP (2 h, 1× pepsin); lane 4 shows CP (3 h, 1× pepsin); lane 5 shows CP (1 h, 2× pepsin); lane 6 shows CP (2 h, 2× pepsin); lane 7 shows CP (3 h, 2× pepsin); lane 8 shows CP (1 h, 4× pepsin); lane 9 shows CP (2 h, 4× pepsin); lane 10 shows CP (3 h, 4× pepsin); lane 11 shows CP (30 min, 8× pepsin); lane 12 shows CP (1 h, 8× pepsin); lane 13 shows CP (3 h, 8× pepsin); lane 14 shows CP (0 min, 8× inactivated pepsin); lane 15 shows CP (2 h, 8× pepsin); lane 16 shows CP (no pepsin); and lane 17 shows (lx pepsin only).

In contrast to modified phytases shown in FIG. 5, phytase that was purified from a commercial available sample (commercial phytase; as shown in FIG. 6) was stable in synthetic gastric fluid. Increasing the amount of pepsin in the synthetic gastric to 8-fold higher concentrations than are typically used in the assay and increasing the incubation time of the enzyme from 10 minutes to 3 hours failed to digest the enzyme.

Figure 7:
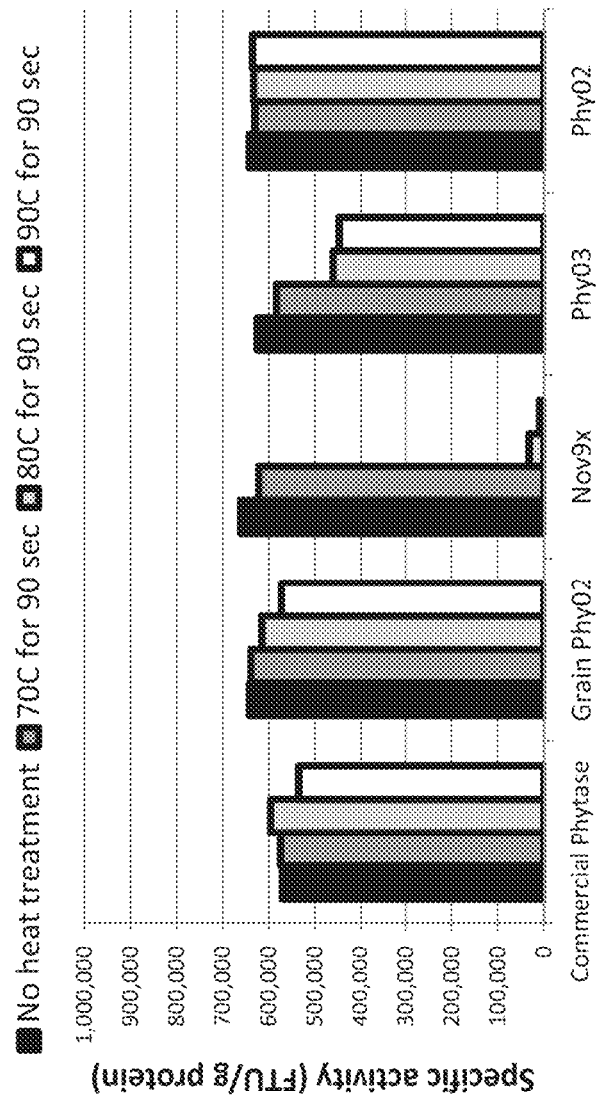
FIG. 7 illustrates thermal stability of modified phytases.

Thermal stability of enzymes. Phytases were extracted from microbial sources (Phy02, Nov9X, Phy03), transgenic seed (Phy02) or a commercially available product, diluted to a common enzyme concentration (5 nM) in assay buffer, and incubated for 90 seconds at various temperatures. Subsequently, the residual enzyme activity was assayed for phytase activity at 37° C., as described above. FIG. 7 illustrates thermal stability of modified phytases. Referring to this figure, Nov9X, Phy02, and Phy03 were purified from recombinant *E. coli* expression hosts. Grain Phy02 was purified from transgenic corn grain. Commercial phytase was purified from a commercially available sample (AB Vista). Both Phy02 and Phy03 had improved thermal stability relative to Nov9X.

Thermal Stability of Phytases in Animal Diets Under Pelleting Conditions.

Phytases were formulated into corn-soy diets at approximately 3000 FTU/kg. Phy02, Phy03 and Nov9X were provided as grain from transgenic corn, milled to particle sizes of approximately 0.5 mm. Three commercially available enzymes were also incorporated into similar diets at rates of 3000 FTU/kg. Diets were then passed through a feed pellet mill with varying conditioning temperatures (60° C. to 90° C.). Following pelleting, feed samples were milled to a particle size of approximately 1 mm, and phytase activity was measured in the milled feed. In each case, the fraction of enzyme activity that survived the pelleting conditions was expressed as a percentage of the enzyme activity that could be detected in the pre-pelleted (mash) feed.

Example 5. Enzyme Performance in Broilers

Figure 8:
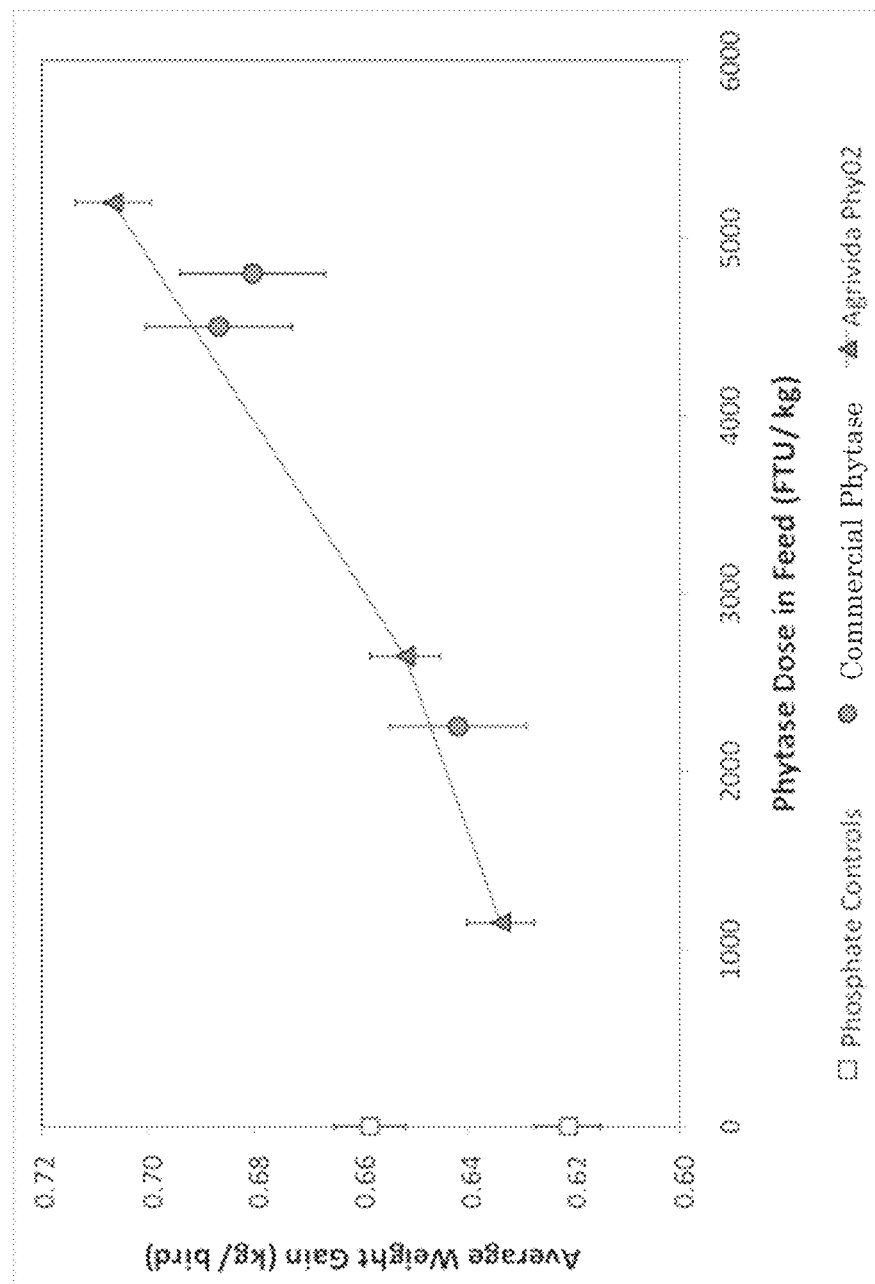
FIG. 8 illustrates body weights of broilers fed on diets containing grain-expressed phytase and a microbially produced commercial control phytase (Commercial Phytase).

A basal corn-soy diet was prepared with a low content of inorganic phosphate. Replicate diets were prepared from this basal diet by adding a commercially available, microbially produced enzyme (denoted as "Commercial Phytase" in FIG. 8) or milled corn grain expressing Phy02, varying the total amount of enzyme incorporated into each diet. For Phy02, a small amount of corn was omitted from the basal diet to account for the transgenic grain that was being added back to supply the enzyme. Control diets were prepared in which the amount of inorganic phosphate was increased relative to the basal diet. Male broiler chicks were distributed among various feed treatments in pens with about 12 birds per pen, and 6 replicate pens per treatment. The feed was provided in mash form. FIG. 9 illustrates body weights of broilers fed on diets containing grain-expressed phytases. A negative control basal diet containing 0.2% PO4, and a positive control basal diet containing 0.5% PO4, lacking enzyme were used in the study. Diets that contained enzyme were based on the 0.2% PO4 basal diet. Phy02 was added to the diets at a rate of 1000 to 5000 FTU/kg; Commercial Phytase were added to the diets at rates of 2000 to 5000 FTU/kg. After 21 days, birds were weighed and compared to determine the effect of the various enzyme treatments. It was observed that milled grain expressing Phy02 had a dose response in body weight gain that was improved relative to the dose response obtained from the microbially produced, commercial enzyme.

High Phosphate—High Phytase Broiler Feeding Trial

Figures 9A, 9B:
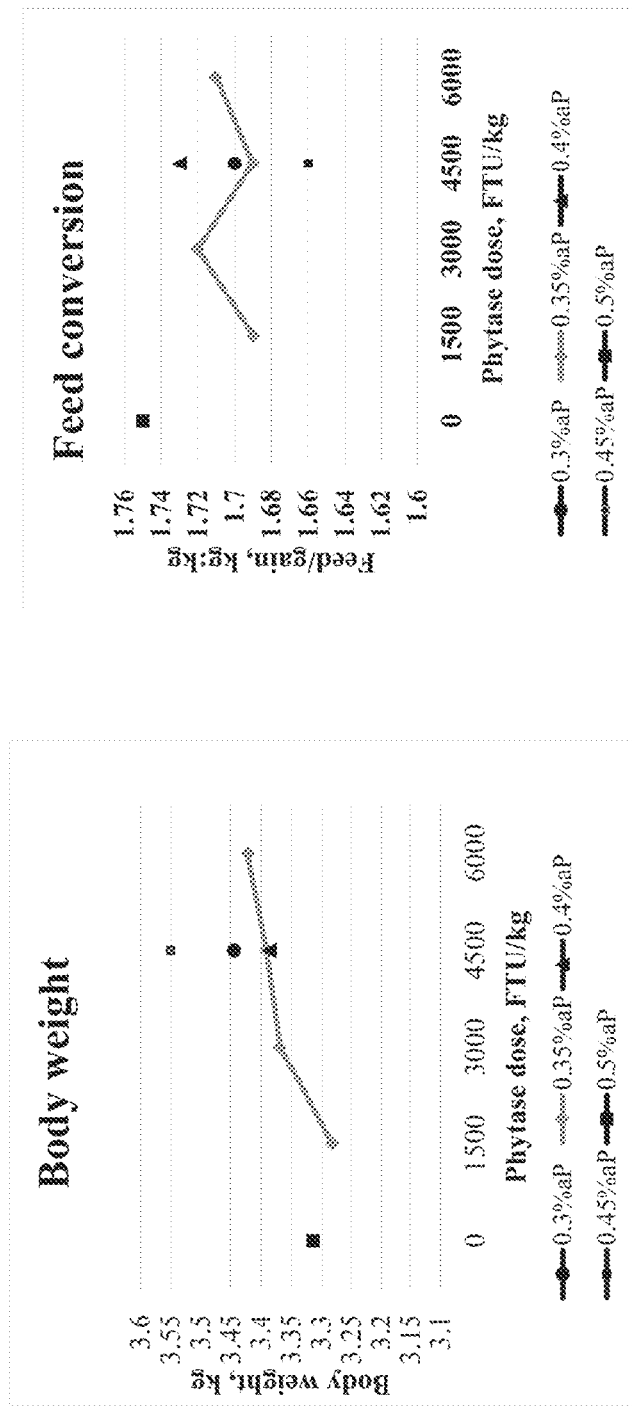
FIGS. 9A-9B illustrate body weight (FIG. 10A) and feed conversion (FIG. 10B) for broilers fed on diets containing different doses of phytase and dietary available phosphorus (aP) through 45-day of age.

Ross male broilers (768 day-old chicks) placed in floor pens with 8 treatments of 6 replicate pens each and 16 chicks per pen. Birds were fed corn, soybean meal, and poultry fat based diets that were pelleted (80-82° C.; crumbled in starter phase) and fed through 45 day of age. FIGS. 9A-9B illustrate animal performance through 45-day within different dietary available phosphorus (aP). FIG. 9A illustrates body weight of the animals. FIG. 9B illustrates feed conversion. Treatments include a positive control with 0.50% available phosphorus (aP) and 1.0% calcium (Ca) for starter, grower, and finisher diets or phytase supplemented diets containing 1500, 3000, 4500 or 6000 FTU/kg phytase with 0.35% aP and 0.85% Ca throughout all growth phases. The reduced aP and Ca diet accounted for the 0.15% uplift of P (and Ca) availability from feeding phytase. Three additional diets were included with 0.30%, 0.40%, and 0.45% aP (0.75%, 0.95% and 1.05% Ca, respectively) within the 4500 FTU/kg phytase level, creating an aP titration (including the 0.35% aP and 0.85% Ca diet mentioned previously). Unlike standard poultry production, the P and Ca levels were not changed (reduced) in any of the treatments through 45 day, resulting in an adequate or overfeeding of P and Ca during the later period. Results show that feeding high levels of phytase with reduced aP and Ca (-0.15%), performed as good or better than a high aP or Ca diet, even with aP and Ca levels above phytase-containing broiler requirements in later periods of production. The birds fed 0.45% aP with 4500 FTU/kg phytase had the overall best performance with 240 g heavier body weight and 9 points (0.9) lower feed conversion than the high phosphate (0.5% aP) treatment.

Reduced Nutrient—High Phytase Broiler Feeding Trial

Cobb male broilers (1598 day-old chicks) were placed into floor pens with 9 treatments of 10 or 11 replicate pens each and 17 chicks per pen. Treatment and study design is shown in Table 9 below. Three treatments were fed a commercial type pelleted diet (crumbled in starter phase) with standard amino acid and metabolizable energy level (100% AA/ME). The 100% AA/ME starter, grower, and finisher diets contained 3035, 3100, and 3170 kcal/kg metabolizable energy and 1.18%, 1.05%, and 0.95% digestible lysine, respectively. The remaining 5 treatments had a 3% reduction (97% AA/ME) of energy and lysine (with other amino acids reduced at a similar ratio) during each phase of the 42-day study. Within both the 100% AA/ME and 97% AA/ME groups, there was a positive control (PC) treatment fed standard available phosphorus (aP; 0.45%, 0.40%, and 0.38% during starter, grower, and finisher, respectively) and calcium (Ca; 0.95%, 0.85%, and 0.80% during starter, grower, and finisher, respectively). There was also a negative control (NC) treatment fed 0.15% less aP and 0.12% less Ca. Phytase was added to the NC at either 1000 FTU/kg in the 100% AA/ME group or 500, 1000, 3000, or 6000 FTU/kg in the 97% AA/ME group. Final bird weights and feed consumption were measured on day 41. On day 42, birds from 5 replicate pens per treatment were processed to determine carcass and breast meat yield. Day 41 breast meat weight was calculated by multiplying 42d percent breast meat yield (treatment average) by average bodyweight at day 41 (on a pen basis). Breast meat efficiency (by pen) was then calculated by dividing average bird feed intake by average breast meat weight at day 41.

TABLE 9

Study Design

| Trt Group | Basal Diet | Ca/aP | Phytase Level | No. Pens | No. Birds per Pen | Total No. Birds per Trt |
|---|---|---|---|---|---|---|
| 1 | 100% AA/ME | PC | 0 FTU/kg | 11 | 17 | 187 |
| 2 | | NC | 0 FTU/kg | 11 | 17 | 187 |
| 3 | | | 1000 FTU/kg | 10 | 17 | 170 |
| 4 | 97% AA/ME | PC | 0 FTU/kg | 11 | 17 | 187 |
| 5 | | NC | 0 FTU/kg | 11 | 17 | 187 |
| 6 | | | 500 FTU/kg | 10 | 17 | 170 |
| 7 | | | | 10 | 17 | 170 |
| 8 | | | 3000 FTU/kg | 10 | 17 | 170 |
| 9 | | | 6000 FTU/kg | 10 | 17 | 170 |

Figure 10:
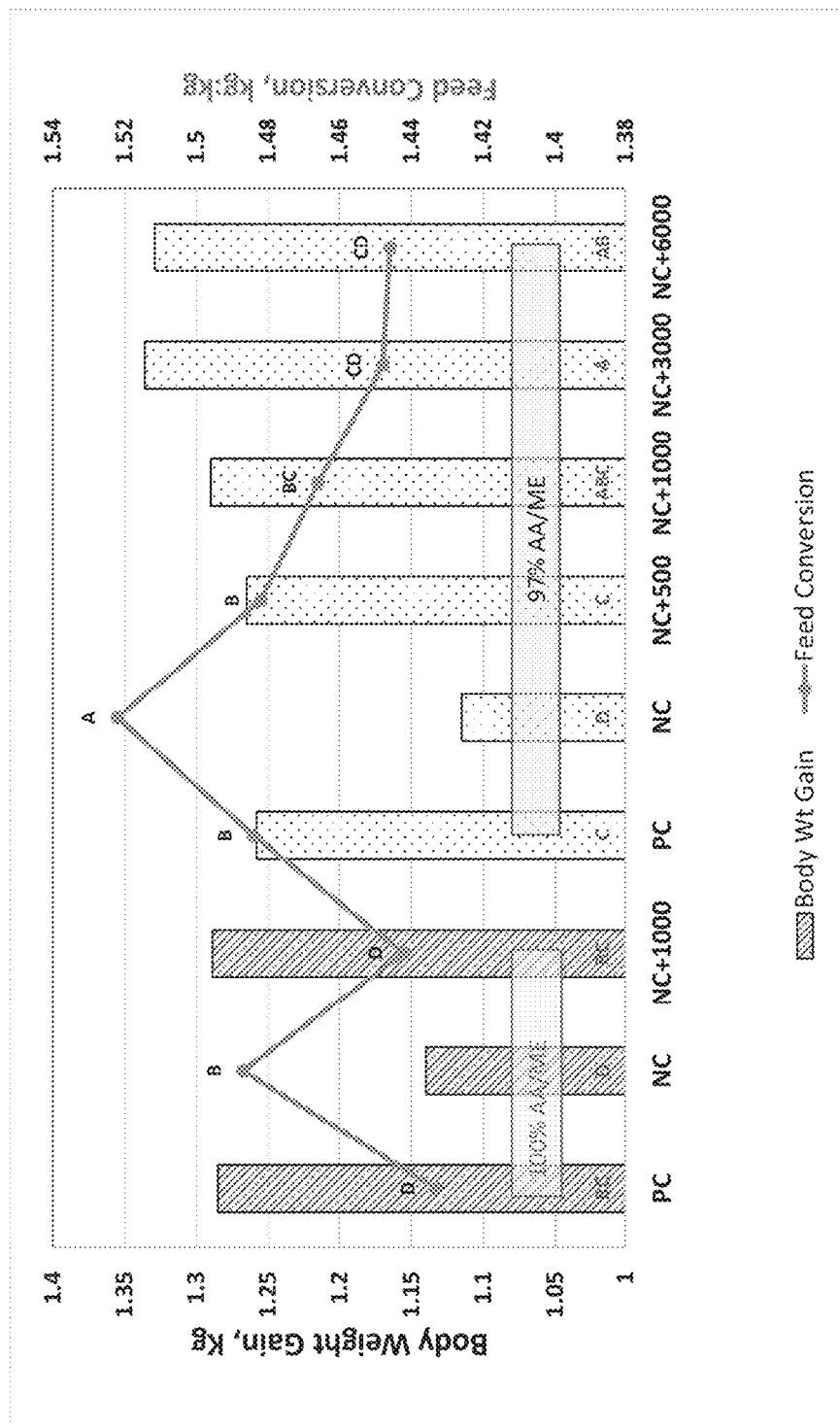
FIG. 10 illustrates body weight gain and feed conversion for broilers fed on diets containing different doses of phytase, different levels of dietary available phosphorus (P) and calcium (Ca), and different levels of amino acids (AA) and metabolizable energy (ME), through 28 day of age.
Figure 11:
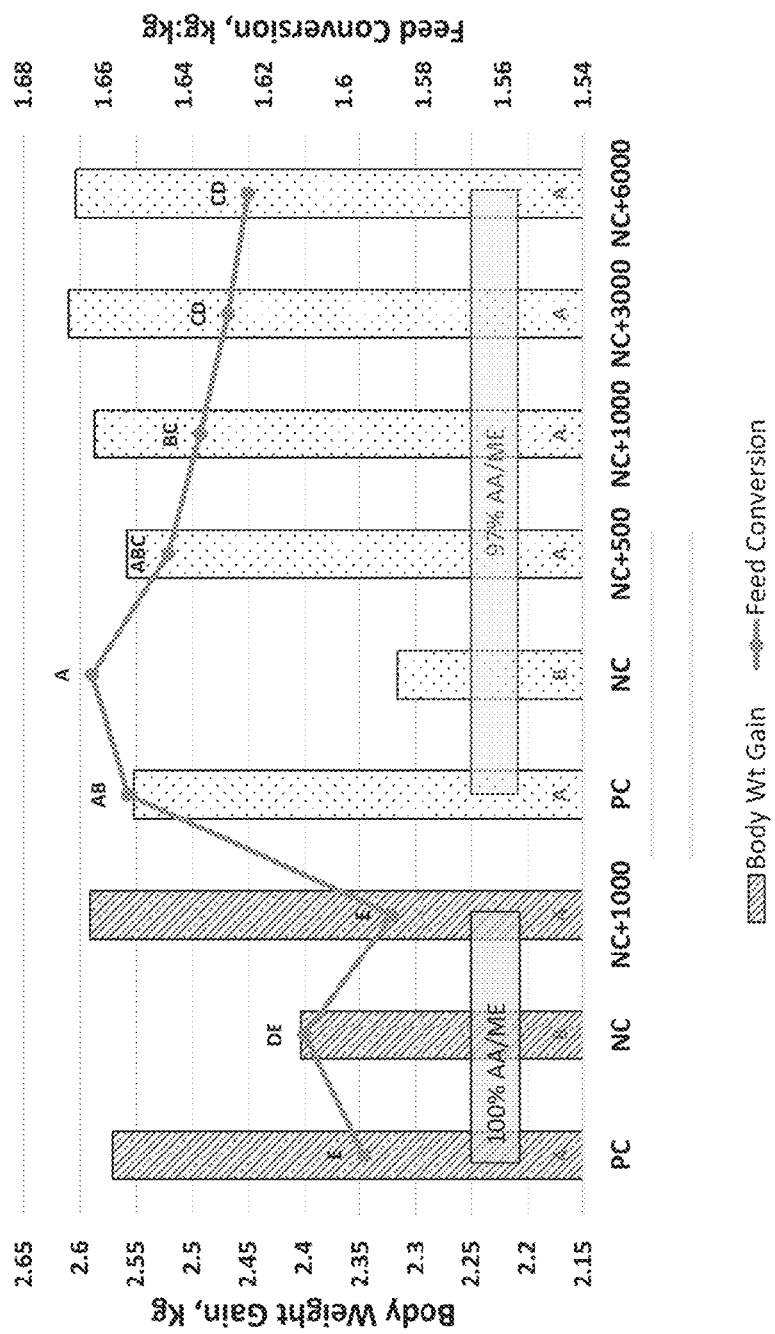
FIG. 11 illustrates weight gain and feed conversion for broilers fed on diets containing different doses of phytase, different levels of dietary available phosphorus (P) and calcium (Ca), and different levels of amino acids (AA) and metabolizable energy (ME), through 42 day of age.
Figure 12:
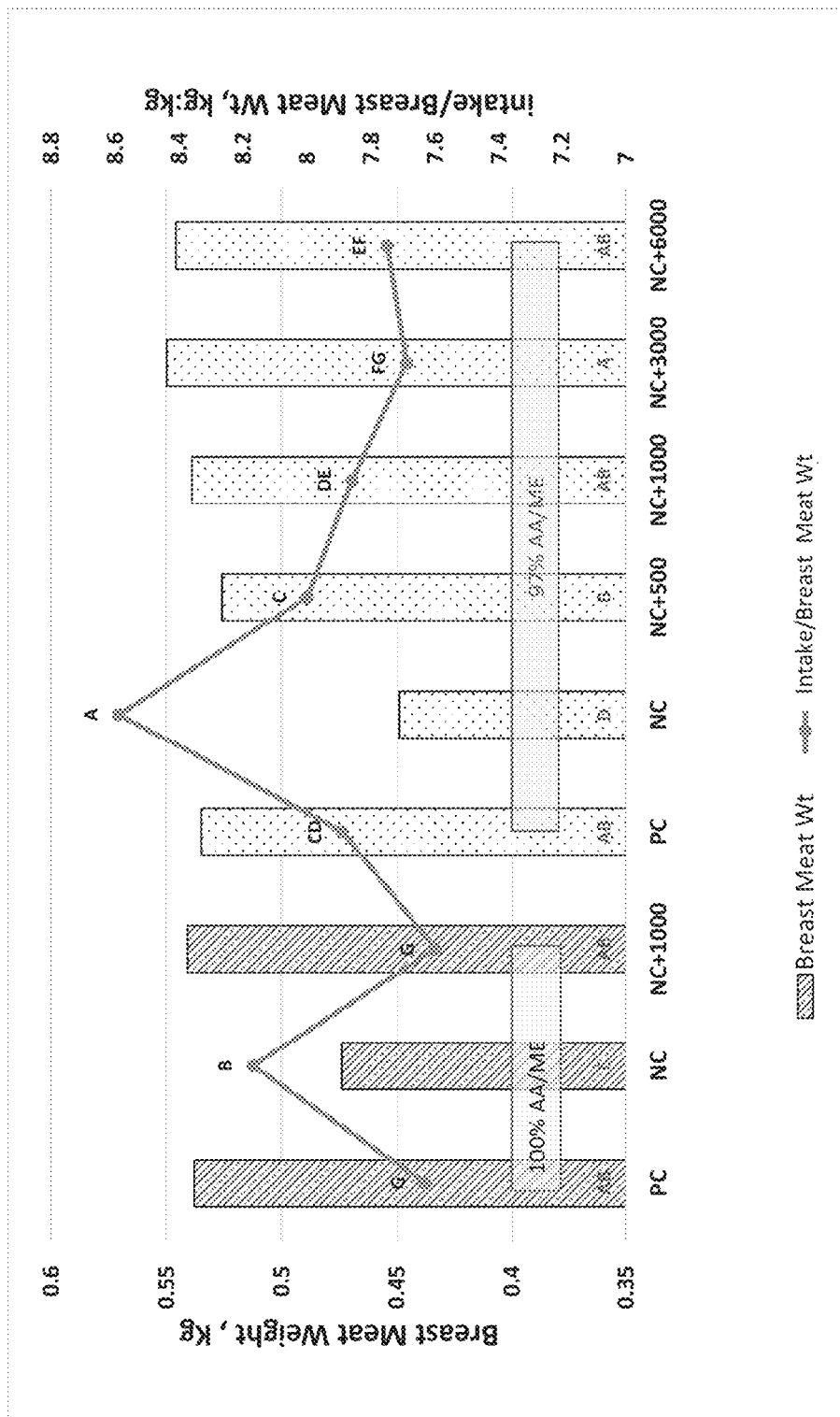
FIG. 12 illustrates breast meat weight and intake/breast meat weight for broilers fed on diets containing different doses of phytase, different levels of dietary available phosphorus (P) and calcium (Ca), and different levels of amino acids (AA) and metabolizable energy (ME), through 42 day of age.

FIG. 10 illustrates bird performance through 28 day of age. FIG. 11 illustrates bird performance through 42 day of age. FIG. 12 illustrates the ratio of intake per breast meat weight through 42 day of age. Letters ABCD in FIGS. 10, 11, and 12 refer to values within variable that are statistically different (P<0.05). Referring to these figures, results of feeding trials for birds through 28 and 42 days of age demonstrated that reducing aP and Ca or combination of aP, Ca, energy and amino acids (in absence of phytase) reduced body weight gain (BWG) and feed conversion (FCR). Within the 100% AA/ME diet, supplementing the negative control (NC) with 1000 FTU/kg phytase brought BWG and FCR back to positive control (PC) levels at 28 and 42 days of age. Addition of 3000 FTU/kg to the NC, 97% AA/ME diet resulted in similar FCR and greater BWG than the PC, 100% AA/ME treatment at 28 days of age. By 42 days of age, 3000 and 6000 FTU/kg addition to NC, 97% AA/ME diet resulted in similar FCR and greater BWG than the NC, 100% AA/ME treatment. Efficiency of breast meat yield was more affected (worse) by the reduced Ca and P than reduced energy and amino acids, with a synergistic response when both were reduced. A similar response was observed with breast meat weight, but the reducing energy and amino acids didn't reduce weight alone. Adding phytase to the NC, 97% AA/ME diet significantly improved breast meat weight (same as PC, 100% AA/ME birds) and breast meat efficiency. Adding 3000 FTU/kg phytase to NC, 97% AA/ME diet had better breast meat efficiency than adding 500 or 1000 FTU/kg to same diet and was equivalent to the PC, 100% AA/ME treatment.

Adequate and Reduced Nutrients—High Phytase Broiler Feeding Trial

Figure 13:
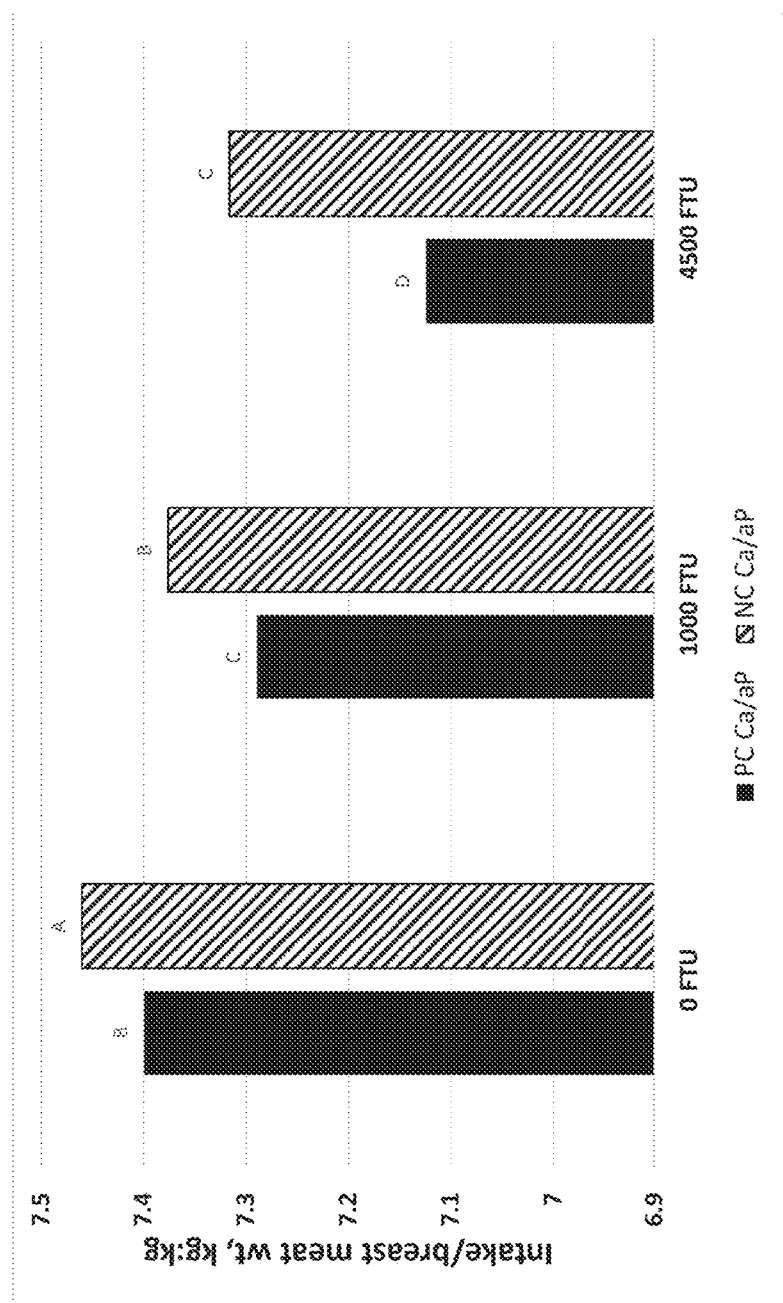
FIG. 13 illustrates breast meat efficiency (feed intake per breast meat weight) for broilers fed on diets containing different doses of phytase and dietary available phosphorus (aP) and calcium (Ca).
Figure 14:
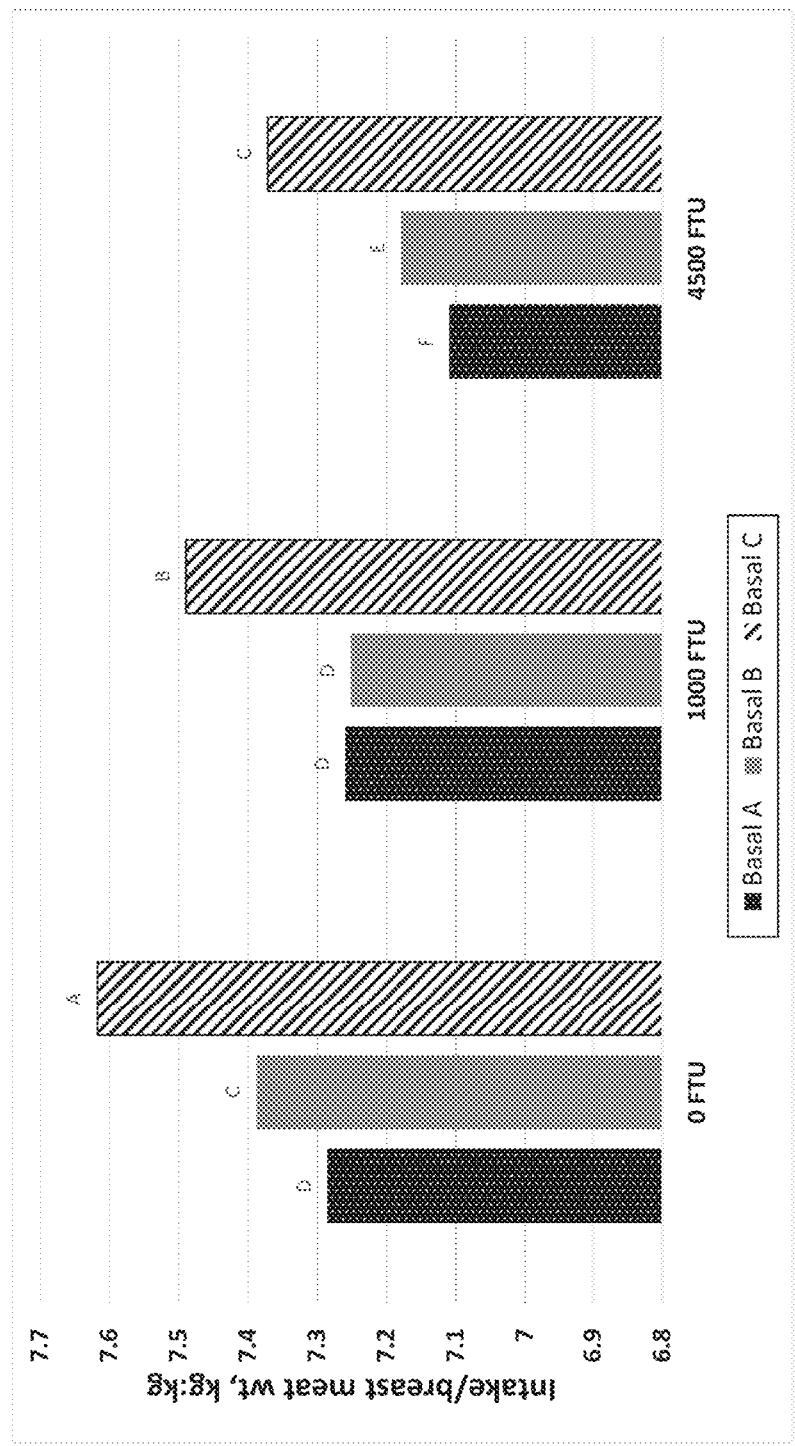
FIG. 14 illustrates breast meat efficiency for broilers fed on basal diets A, B, and C containing different doses of phytase.

Ross broilers (3366 male and female day-old chicks) placed into floor pens with 18 treatments of 11 replicate pens each and 17 chicks per pen. Birds were fed industry-type starter (0-14d), grower (15-28d), and finisher (29-49d) corn, soybean meal, & DDGS diets with soy hulls added (up to 4.2%) to reduce energy and amino acids. Three different basal diets were fed (dietary nutrient profiles are shown in Table 10):

Basal A—standard industry energy and lysine recommendations (other amino acids remained at similar ratio to Lysine, across basal diets);

Basal B—2, 3, or 5% energy/amino acid reduction during starter, grower, or finisher, respectively;

Basal C—3, 4, or 6% energy/amino acid reduction during starter, grower, or finisher, respectively Within each basal diet 3 different levels of phytase were fed: 0, 1000, or 4500 FTU/kg. Within each enzyme level 2 different calcium (Ca) and available phosphorus (aP) levels were fed: positive control (PC) as shown in Table 10 or negative control (NC; −0.12% Ca and −0.15% aP). Final bird weights and feed consumption were measured on day 49. On days 50 and 51, birds from 4 or 6 replicate pens per treatment (1000 FTU/kg phytase or 0 and 4500 FTU/kg phytase treatments, respectively) were processed to determine carcass and breast meat yield. Day 49 breast meat weight was calculated by multiplying 50/51d percent breast meat yield (treatment average) by average bodyweight at day 49 (on a pen basis). Breast meat efficiency (by pen) was then calculated by dividing average bird feed intake by average breast meat weight at day 49. Same calculation was done for carcass weight and efficiency. FIG. 13 illustrates breast meat efficiency—phytase by Ca/aP interaction. Letters ABCD refer to values that are statistically different (P<0.05). FIG. 14 illustrates breast meat efficiency—phytase by basal diet interaction.

TABLE 10

Formulated Dietary Nutrient Profiles

| | Phase | | | | | | | | |
|---|---|---|---|---|---|---|---|---|---|
| | Starter | | | Grower | | | Finisher | | |
| Basal | A | B | C | A | B | C | A | B | C |
| ME, kcal/lb | 1360 | 1333 | 1319 | 1400 | 1358 | 1344 | 1440 | 1368 | 1354 |
| Crude Protein, % | 21.00 | 20.58 | 20.37 | 19.00 | 18.43 | 18.24 | 18.00 | 17.10 | 16.07 |
| Ca, % | PC = 0.96; NC = 0.84 | | | PC = 0.86; NC = 0.74 | | | PC = 0.80; NC = 0.68 | | |
| aP, % | PC = 0.48; NC = 0.33 | | | PC = 0.43; NC = 0.28 | | | PC = 0.40; NC = 0.25 | | |
| Dig. Lysine, % | 1.18 | 1.16 | 1.14 | 1.07 | 1.04 | 1.03 | 0.95 | 0.903 | 0.893 |
| Dig. Met + Cys, % | 0.88 | 0.862 | 0.854 | 0.80 | 0.776 | 0.768 | 0.74 | 0.703 | 0.696 |
| Dig. Threonine, % | 0.77 | 0.755 | 0.747 | 0.69 | 0.669 | 0.662 | 0.65 | 0.618 | 0.611 |

TABLE 11

Basic Study Design

| Group | Basal Diet | Ca/aP | Phytase Level |
|---|---|---|---|
| 1 | Basal A | PC | 0 FTU/kg |
| 2 | | NC | |
| 3 | | PC | 1000 FTU/kg |
| 4 | | NC | |
| 5 | | PC | 4500 FTU/kg |
| 6 | | NC | |
| 7 | Basal B | PC | 0 FTU/kg |
| 8 | | NC | |
| 9 | | PC | 1000 FTU/kg |
| 10 | | NC | |
| 11 | | PC | 4500 FTU/kg |
| 12 | | NC | |
| 13 | Basal C | PC | 0 FTU/kg |
| 14 | | NC | |
| 15 | | PC | 1000 FTU/kg |
| 16 | | NC | |
| 17 | | PC | 4500 FTU/kg |
| 18 | | NC | |

Reducing energy and amino acids resulted in worse feed conversion (FCR) with Basal A being the best and Basal C having the highest FCR (49-day performance, Table 12). Basal B had equivalent 49-day body weight gain as Basal A, with Basal C being the lowest. Basal B had greater 49-day carcass and breast meat weight than Basal A and C, however efficiency of carcass and breast meat yield responded linearly improving as energy and amino acids increased (Table 13). Both phytase levels had significantly better BWG than the birds fed no phytase through 49-day (Table 12), with 4500 FTU/kg being larger than 1000 FTU/kg through 28-day and 42-day. As phytase level increased 49-day FCR and weight and yield efficiency of both carcass and breast meat improved, with 4500 FTU/kg fed birds being better than those fed 1000 FTU/kg (Table 13). There was a phytase by Ca/aP interaction observed in breast meat efficiency, resulting from the improvement from increasing phytase was more noticeable in the standard Ca/aP (PC) as compared to reduced Ca/aP (NC; FIG. 13). A phytase by basal diet interaction was observed in breast meat efficiency, as the response from increasing phytase was most notable in the reduced nutrient diets and 1000 FTU/kg was not different from birds not fed phytase in the Basal A (industry standard) diets.

TABLE 12

Overall 49-day Animal Performance

| | Intake, kg | Body Weight Gain, kg | Feed Conversion |
|---|---|---|---|
| Basal | | | |
| 100% ME-AA | 5.135[b] | 2.945[a] | 1.745[c] |
| 98/97/95% ME-AA | 5.334[a] | 2.948[a] | 1.810[b] |
| 97/96/94% ME-AA | 5.380[a] | 2.889[b] | 1.863[a] |
| Phytase | | | |
| 0 FTU/kg | 5.241 | 2.884[b] | 1.818[a] |
| 1000 FTU/kg | 5.288 | 2.931[a] | 1.805[b] |
| 4500 FTU/kg | 5.319 | 2.967[a] | 1.794[c] |
| Ca-aP | | | |
| PC | 5.270 | 2.917 | 1.807 |
| NC | 5.295 | 2.937 | 1.804 |
| P Values | | | |
| Basal | <0.0001 | 0.014 | <0.0001 |
| Phytase | 0.111 | 0.0015 | <0.0001 |
| Ca—P | 0.41 | 0.30 | 0.27 |
| Basal*Phytase | 0.42 | 0.58 | 0.26 |
| Basal*Ca—P | 0.79 | 0.67 | 0.22 |
| Phytase*Ca—P | 0.77 | 0.76 | 0.93 |
| Basal*Phyt*Ca—P | 0.99 | 0.99 | 0.73 |

[abc]values within variable with differing letters are statistically different (P < 0.05)

TABLE 13

Breast Meat and Carcass Weight and Efficiency of Yield Through 49-day

| | Carcass Weight, kg | Carcass Yield Efficiency, kg:kg | Breast Meat Weight, kg | Breast Meat Efficiency, kg:kg |
|---|---|---|---|---|
| Basal | | | | |
| 100% ME-AA | 2.209[a] | 2.326[c] | 0.712[b] | 7.218[c] |
| 98/97/95% ME-AA | 2.216[a] | 2.407[b] | 0.734[a] | 7.272[b] |
| 97/96/94% ME-AA | 2.160[b] | 2.491[a] | 0.718[b] | 7.492[a] |
| Phytase | | | | |
| 0 FTU/kg | 2.161[c] | 2.426[a] | 0.706[c] | 7.429[a] |
| 1000 FTU/kg | 2.194[b] | 2.411[b] | 0.721[b] | 7.333[b] |
| 4500 FTU/kg | 2.230[a] | 2.387[c] | 0.737[a] | 7.220[c] |

TABLE 13-continued

Breast Meat and Carcass Weight and Efficiency of Yield Through 49-day

| | Carcass Weight, kg | Carcass Yield Efficiency, kg:kg | Breast Meat Weight, kg | Breast Meat Efficiency, kg:kg |
|---|---|---|---|---|
| Ca-aP | | | | |
| Standard | 2.193 | 2.405 | 0.725$^A$ | 7.271$^b$ |
| Reduced | 2.197 | 2.412 | 0.717$^B$ | 7.384$^a$ |
| P Values | | | | |
| Basal | 0.0014 | <0.0001 | 0.0003 | <0.0001 |
| Phytase | 0.0003 | <0.0001 | <0.0001 | <0.0001 |
| Ca-aP | 0.78 | 0.38 | 0.073 | <0.0001 |
| Basal*Phytase | 0.55 | 0.094 | 0.86 | 0.023 |
| Basal*Ca-aP | 0.48 | 0.0024 | 0.57 | 0.38 |
| Phytase*Ca-aP | 0.83 | 0.88 | 0.15 | 0.0001 |
| Basal*Phyt*Ca-aP | 0.98 | 0.19 | 0.76 | 0.0014 |

$^{abc}$Values within variable with differing letters are statistically different (P < 0.05)

Low Phosphate—Very High Phytase Broiler Feeding Trial

Cobb male broilers (1632 one day-old male chicks) placed into floor pens with 8 treatments of 12 replicate pens each and 17 chicks per pen. Birds were fed a commercial type pelleted diet (crumbled up to 14-day). There was a positive control (PC) treatment with standard phosphate; 0.45% aP and 0.93% Ca in starter (1 through 21-day) and 0.40% aP and 0.84% Ca in grower (21 through 42-day). The negative control (NC) treatment had aP reduced by 0.15% (Ca remained the same). Phytase was added to the NC diet at either 250, 500, 1000, 3000, 6000 or 60000 FTU/kg. On days 21 and 42, 3 birds per pen were euthanized and tibia (to measure ash, mineralization) and ileal digesta samples were taken. Chromic Oxide was included in the diet as an indigestible marker to measure ileal phosphorus digestibility. Through 14, 21, and 42-day birds fed 60,000 FTU/kg phytase had highest body weight gain (BWG), while treatments of 1,000 FTU/kg or more were larger than PC at 42-day (Table 14). The 60,000 FTU/kg birds also had the most bone ash (mineralization), with significantly higher ash weight than the PC group at 42-day (Table 15). The 60,000 FTU/kg phytase group also had numerically the highest ileal phosphorus digestibility (Table 16).

TABLE 14

Overall 42-day Performance

| Treatment | Feed Intake, kg | Body Wt Gain, kg | Adj. Feed Conversion |
|---|---|---|---|
| Positive Control | 4.501$^{ab}$ | 2.889$^{bc}$ | 1.558$^{bc}$ |
| Negative Control | 3.597$^d$ | 2.228$^e$ | 1.615$^a$ |
| 250 U + NC | 4.334$^c$ | 2.757$^d$ | 1.572$^b$ |
| 500 U + NC | 4.372$^{bc}$ | 2.815$^{cd}$ | 1.553$^{bc}$ |
| 1000 U + NC | 4.522$^a$ | 2.921$^{ab}$ | 1.548$^c$ |
| 3000 U + NC | 4.588$^a$ | 2.967$^{ab}$ | 1.546$^c$ |
| 6000 U + NC | 4.546$^a$ | 2.942$^{ab}$ | 1.546$^c$ |
| 60,000 U + NC | 4.617$^a$ | 2.988$^a$ | 1.545$^c$ |
| SEM | 0.033 | 0.022 | 0.005 |
| TRT P Value | <0.0001 | <0.0001 | <0.0001 |
| Block P Value | 0.0045 | 0.0033 | 0.072 |

TABLE 15

Tibia Ash Weight and Percent of Dry Bone

| | 21 d Tibia Ash | | 42 d Tibia Ash | |
|---|---|---|---|---|
| Treatment | Grams$^1$ | % | Grams$^1$ | % |
| Positive Control | 2.68$^{cd}$ | 27.51$^{abc}$ | 11.44$^{bc}$ | 28.52$^{ab}$ |
| Negative Control | 1.91$^e$ | 22.86$^d$ | 8.30$^d$ | 25.01$^d$ |
| 250 U + NC | 2.61$^d$ | 26.07$^c$ | 10.78$^c$ | 26.55$^c$ |
| 500 U + NC | 2.66$^{cd}$ | 26.26$^{bc}$ | 11.15$^{bc}$ | 27.39$^{bc}$ |
| 1000 U + NC | 2.90$^{bc}$ | 27.34$^{abc}$ | 11.70$^{ab}$ | 27.59$^{abc}$ |
| 3000 U + NC | 3.02$^{ab}$ | 27.65$^{ab}$ | 12.01$^{ab}$ | 28.13$^{ab}$ |
| 6000 U + NC | 2.85$^{bc}$ | 27.28$^{abc}$ | 11.99$^{ab}$ | 27.94$^{abc}$ |
| 60,000 U + NC | 3.14$^a$ | 27.86$^a$ | 12.46$^a$ | 28.96$^a$ |
| SEM | 0.05 | 0.33 | 0.20 | 0.32 |

$^{a-e}$Values within columns with no common superscript are statistically different (P < 0.05).
$^1$Tibia ash weight; n = 3 tibia per pen

TABLE 16

Ileal Digesta Phosphorus (P) Content and P Digestibility

| Treatment | 21 d Ileal P digestibility (%) | 21 d Ileal P (mg/100 g) | 42 d Ileal P digestibility (%) | 42 d Ileal P (mg/100 g) |
|---|---|---|---|---|
| Positive Control | 65.74$^{ab}$ | 37.6$^{ab}$ | 57.67$^{ab}$ | 37.5 |
| Negative Control | 63.73$^{ab}$ | 36.0$^{ab}$ | 50.05$^b$ | 32.6 |
| 250 U + NC | 66.02$^{ab}$ | 28.9$^b$ | 51.96$^b$ | 30.8 |
| 500 U + NC | 60.29$^b$ | 41.8$^a$ | 49.64$^b$ | 34.9 |
| 1000 U + NC | 63.54$^{ab}$ | 33.1$^{ab}$ | 52.19$^b$ | 32.1 |
| 3000 U + NC | 65.20$^{ab}$ | 33.4$^{ab}$ | 55.93$^{ab}$ | 30.0 |
| 6000 U + NC | 66.69$^{ab}$ | 33.7$^{ab}$ | 59.74$^{ab}$ | 28.0 |
| 60,000 U + NC | 71.07$^a$ | 25.6$^b$ | 64.66$^a$ | 25.7 |
| SEM | 2.25 | 0.003 | 2.39 | 2.8 |

$^{ab}$Values within columns with no common superscript are statistically different (P < 0.05).

Example 6. Phytase Expression from the Two T-DNA Inserts in PY203

As described above, PY203 is a transgenic maize line that experienced T-DNA insertions into two separate chromosomal loci during the initial transformation event. These loci have been labelled Locus 3293 and Locus 3507. The expression cassettes in both loci contribute to the total amount of phytase enzyme that accumulates in seed from these plants. To assess how much of the phytase activity could be attributed to each locus, the two loci were genetically separated, producing seed that carried the T-DNA in Locus 3293, in Locus 3507, or both loci, and then assayed the seed for phytase activity.

Pollen was taken from the original PY203 transformant, which was hemizygous for the T-DNA at both loci, and used to pollinate the silks of non-transformed maize. Since the two loci are genetically unlinked, each locus would be expected to be inherited independently among the progeny. In other words, among the progeny, the ratio of seed containing no T-DNAs (nulls), to those containing Locus 3293 alone, to those containing Locus 3507 alone, to those containing both recombinant loci was expected to be 1:1:1:1. The resulting seed were harvested at maturity.

Small shavings were taken from each seed, corresponding to a small amount of endosperm and aleurone tissue. Total DNA was extracted from each sample and tested by PCR for the presence of each recombinant locus. Locus-specific PCR reactions employed a strategy wherein a single primer that was specific to one end of the T-DNA insert was paired with a single primer that was specific to the chromosomal DNA adjacent to that insert. For example, primer 696 (SEQ ID NO: 105) can be paired with primer 516 (SEQ ID NO: 104) to amplify the 186 bp (SEQ ID NO: 128) sequence on the border of T-DNA and maize DNA. More PCR primers unique to event PY203 are listed in Table 18. Thus, unique primer pairs could be prepared for each of the two recombinant loci. Following genotyping of 60 individual seeds via the locus-specific PCR assay, the segregation ratio of (nulls): (Locus 3293): (Locus 3507): (both loci) was found to be 17:13:14:16 (or 1.3:1.0:1.1:1.2, which closely approximates the expected 1:1:1:1), which is consistent with the expectation for two unlinked loci, as described above.

Figure 15:
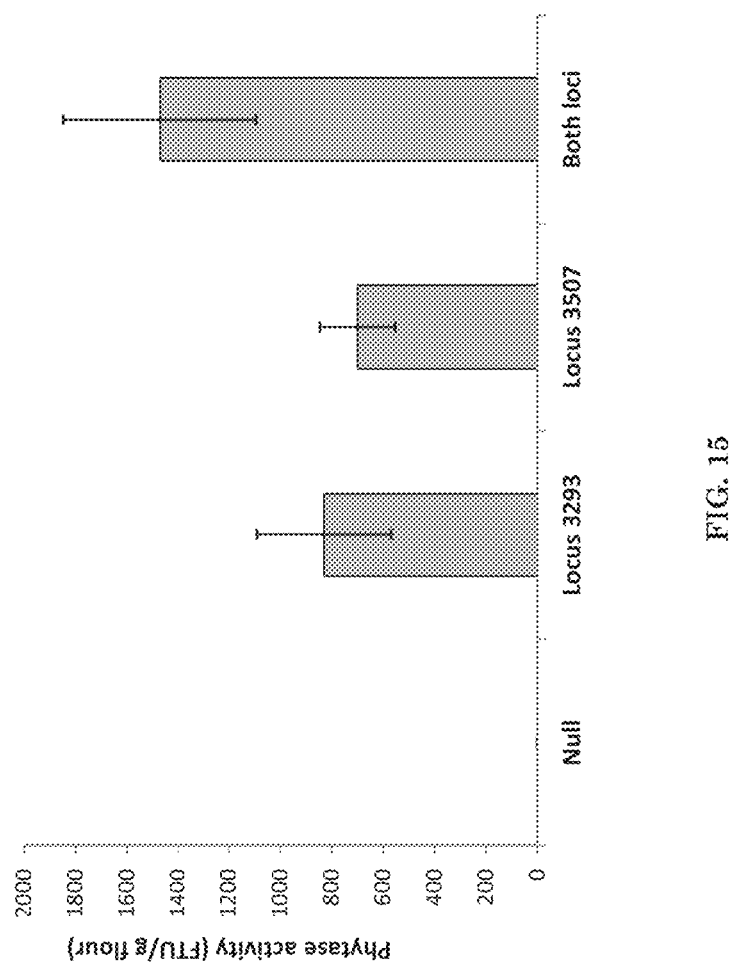
FIG. 15 illustrates phytase activity that is produced from each of the two independent T-DNA inserts in seed from progeny of PY203.
Figure 16:
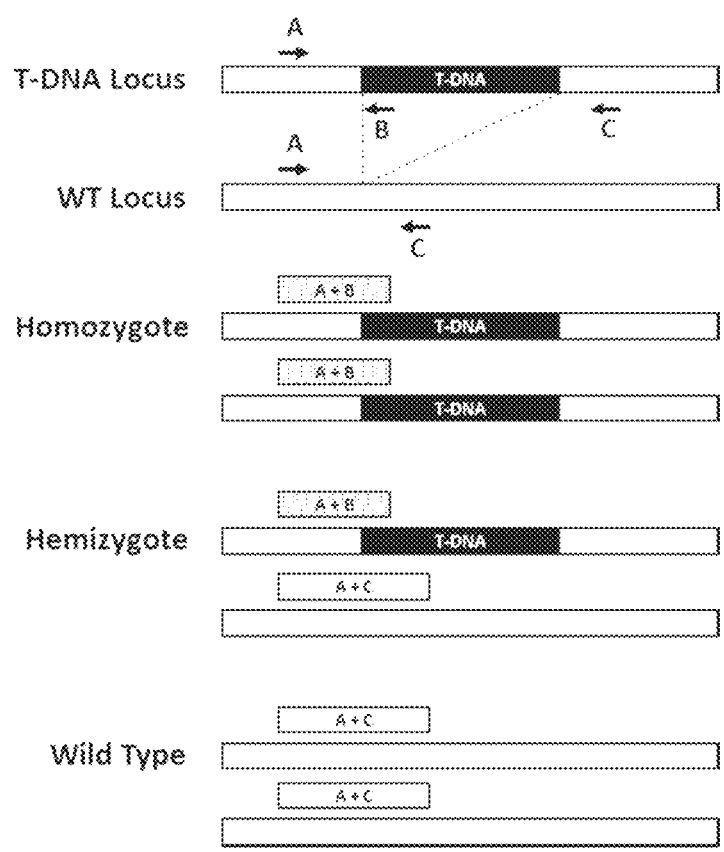
FIG. 16 illustrates general multiplex PCR assay design used to determine presence of the T-DNA locus and zygosity.

Each of these seed was then individually ground to a fine powder (flour) and assayed for phytase activity, as described previously. Results of these assays are shown in FIG. 15. This figure illustrates phytase activity that is produced from each of the two independent T-DNA inserts in seed from progeny of PY203. The two loci are genetically unlinked. Where present, each locus was hemizygous in the tested seed. The results indicate that the two loci contribute nearly equal amounts of phytase expression, and that the combined activity from both loci is additive. Null seed, carrying neither locus, had no detectable phytase activity.

Example 7. Phytase Expression in PY203×PY53 (or PY53×PY 203) Crosses

Progeny from original "T0" transgenic maize plants were grown and backcrossed or crossed with progeny of "T0" transgenic maize plants from different events. Hybrid ears were made by cross-pollinating transgenic line P203 plants with transgenic line P53 plants, or vice versa. For example, silks on PY203 transgenic plants were pollinated with pollen from individual PY53 transgenic plants (PY203×PY53), or silks on PY53 transgenic plants were pollinated with pollen from PY203 transgenic plants (PY53×PY203). Mature, dried seed were collected from the resulting ears, genotyped, and then individually ground to a fine powder (flour) and assayed for phytase activity, as described previously. It was observed that phytase activity produced from the T-DNA inserts in seed from progeny of PY203 and PY53 was cumulative for each insert. While the homozygous PY203 parent used in the cross had an activity level of 3395+/−173 FTU/g, and the homozygous PY53 parent used in the cross had an activity level of 3754+/−393 FTU/g, the combined homozygous ("stacked") progeny resulted in an activity level of 8089+/−116 FTU/g. That is, the results indicate that the independent PY53 and PY203 loci contribute nearly equal amounts of phytase expression, and that the combined activity from both loci is additive. Similar results were obtained through crossing of PY15 and PY203, as well as crossing experiments with other events.

At each generation, some individual ears were self-pollinated. PCR method was applied to select homozygous plants as described in Example 8.

Example 8. PCR Assays for Identifying and Determining Zygosity of PY15, P53, PY203, PY209, PY1053 and PY1203 Events Maize phytase events PY15 and PY203 carry transgenes that result in seed-specific expression of phytase enzyme. PY15 carries multiple T-DNAs at a single genetic locus and PY203 carries two T-DNAs, each at different genetic loci. Molecular identification and tracking of these transgenes can be done using standard (endpoint, gel-based) PCR or real-time PCR. In addition to determining whether a plant is carrying a transgene, these assays can also determine whether a plant is null, hemizygous (carrying one copy of the/each insertion) or homozygous (carrying two copies of the/each insertion).

FIG. 26 illustrates general multiplex PCR assay design used to determine presence of the T-DNA locus and zygosity. Referring to this figure, A, B, and C with arrows indicate primer binding sites, and rectangular boxes A+B and A+C represent PCR products amplified from respective primer pairs. The multiplex PCR assays include, for each T-DNA locus, one primer (Primer A) that binds to a maize genomic region that is adjacent to where the T-DNA insert is located, one primer (Primer B) that binds to a region in the T-DNA that is close to Primer A, and one primer (Primer C) that binds to a maize genomic region on the other side of the T-DNA and would be close to Primer A if the T-DNA insertion was not present, as in a wild type (WT) locus. When the T-DNA insertion is present, the distance between Primer A and Primer C would be at a significant competitive disadvantage, or too large to amplify a product under the selected PCR amplification conditions and therefore is used to determine zygosity. PCR amplification of product from Primer A+B and Primer A+C would indicate that the T-DNA locus is present and is hemizygous (one-copy). PCR amplification of product from Primer A+B, but not Primer A+C would indicate that the T-DNA locus is present and is homozygous (two-copy). PCR amplification of product from Primer A+C only, would indicate that no T-DNA is present and the plant is WT at this locus.

DNA Extraction

These multiplex PCR assays will work with any DNA extraction method that yields DNA that can be amplified with PCR. A standard DNA extraction method (10XTE+Sarkosyl) that was used in this example is as follows: leaf tissue (standard 1 cm hole punch) is sampled into a 96 deep-well block, metal beads are added, and the block is frozen at −80° C. for at least 30 min. The block is then ground for 45 sec in a Kleco Pulverizer, centrifuged at 4,000 RPM for 3 min, the lid is removed, 300 µl of 10XTE+Sarkosyl is added, the block is resealed, and the block is mixed at room temperature for 10-20 min. After incubation, the block is centrifuged at 4,000 RPM for 5 min, 165 µl of upper aqueous phase is removed and added to a 96-well PCR block, the PCR block is sealed, and the block is incubated at 90° C. for 30 min. After incubation, 20 µl of extract is added to 180 µl of sterile water in a 96-well plate (1:10 dilution) to create the final DNA sample for PCR.

PCR

PY15 and PY203 standard and real-time PCR primers are listed in Table 17 and standard PCR primer combinations with expected PCR product sizes are listed in Table 18.

TABLE 17

Standard and Real-time (RT) PCR Primers and Probes Used to Determine T-DNA Locus Presence and Zygosity of PY15 and PY203 Events

| PCR Assay | Event | Primer or Probe | Primer/ Probe ID | Primer Sequence/ SEQ ID NO | Fluor* | Quencher |
|---|---|---|---|---|---|---|
| Standard/ RT | PY15 | Primer | 580 | CGT TGC ATA GGG TTT GGT TTG (SEQ ID NO: 99) | | |
| Standard/ RT | PY15 | Primer | 688 | TCGACTTGGAGGA GGATG (SEQ ID NO: 100) | | |
| Standard/ RT | PY15 | Primer | 732 | TGGCTAGGACTTGC AGTTT (SEQ ID NO: 101) | | |
| RT | PY15 | Probe | PB10 | ATCTCGCCACCTCT TCCACATCAC (SEQ ID NO: 102) | FAM | BHQ1 |
| RT | PY15 | Probe | PB11 | TGTGATGATGTGGT CTGGTTGGGC (SEQ ID NO: 103) | HEX | BHQ1 |
| Standard | PY203 | Primer | 516 | AACGTGACTCCCTT AATTCTCC (SEQ ID NO: 104) | | |
| Standard/ RT | PY203 | Primer | 696 | CACCAACCTTCTGG CATTTG (SEQ ID NO: 105) | | |
| Standard/ RT | PY203 | Primer | 620 | GATTGCCAAGCTGA AACATTTG (SEQ ID NO: 106) | | |
| Standard | PY203 | Primer | 666 | AATCTGGGCCGCTA TTTCC (SEQ ID NO: 107) | | |
| Standard | PY203 | Primer | 667 | GCCTTGTCTTAGTC ATTGATTTCC (SEQ ID NO: 108) | | |
| RT | PY203 | Primer | 504 | CTCATGATCAGGTT GTCGTTTC (SEQ ID NO: 109) | | |
| RT | PY203 | Primer | 747 | AATCTGGGCCGCTA TTTC (SEQ ID NO: 110) | | |
| RT | PY203 | Primer | 753 | TTTCACACGCCTAG TGG (SEQ ID NO: 111) | | |
| RT | PY203 | Probe | PB6 | CTATCAGTGCTTCC CCAAGTTACTAGAA CC (SEQ ID NO: 112) | FAM | BHQ1 |
| RT | PY203 | Probe | PB8 | TCAGTGTTTGAGGA GGATGTCCACC (SEQ ID NO: 113) | HEX | BHQ1 |
| RT | PY203 | Probe | PB9 | CGCCTTGTCTTAGT CATTGATTTCCTGC (SEQ ID NO: 114) | Cy5 | BHQ |
| RT | PY203 | Probe | PB14 | AATAGGGCCATCG CTCTTAGCCC (SEQ ID NO: 115) | Texas Red | BHQ2 |

*-"Fluor' means fluorophore

TABLE 18

PY15 and PY203 Event and Locus-specific PCR Primer Combinations and PCR Product Sizes

| Event | Locus | Primer A | Primer B | Primer C | PCR Product (bp) | Assay Identifies |
|---|---|---|---|---|---|---|
| PY15 | PY15 | 688 | 580 | | 233 | T-DNA locus |
| PY15 | PY15 | 688 | | 732 | 122 | WT locus |
| PY203 | PY203-3293 | 696 | 516 | | 186 | T-DNA locus |
| PY203 | PY203-3293 | 696 | 504 | | 163 | T-DNA locus (alternate) |
| PY203 | PY203-3293 | 696 | | 620 | 278 | WT locus |
| PY203 | PY203-3507 | 666 | 516 | | 136 | T-DNA locus |
| PY203 | PY203-3507 | 747 | 504 | | 113 | T-DNA locus (alternate) |
| PY203 | PY203-3507 | 666 | | 667 | 104 | WT locus |
| PY203 | PY203-3507 | 747 | | 753 | 124 | WT locus |

Additionally, Primer 504 (B) combines with Primer 747 (A) to amplify PY203 locus 3507. Primer 747 also combines with Primer 753 (B) to amplify wild type locus corresponding to 3507 locus.

Standard PCR is performed with 2 µl of DNA extract and GoTaq (Promega) or Kapa 3G (Kapa Biosystems) PCR Mix in 30 µl reaction volumes with the following components and conditions for each event:

PY15 Standard PCR:
Components (final concentration): PCR Mix with buffer, MgCl$_2$, nucleotides, and enzyme (1×); Primer 580 (200 nM); Primer 688 (200 nM); Primer 732 (800 nM)
Conditions: 95° C., 3 min; 33 cycles (95° C., 30 sec; 60° C., 90 sec; 72° C., 30 sec); 72° C., 8 min PY203 Standard PCR:
Reaction Components (final concentration): PCR Mix with buffer, MgCl$_2$, nucleotides, and enzyme (1×); Primer 516 (400 nM); Primer 696 (400 nM); Primer 620 (400 nM); Primer 666 (400 nM); Primer 667 (400 nM)
Conditions: 95° C., 3 min; 33 cycles (95° C., 30 sec; 60° C., 90 sec; 72° C., 30 sec); 72° C., 8 min.

Figure 17:
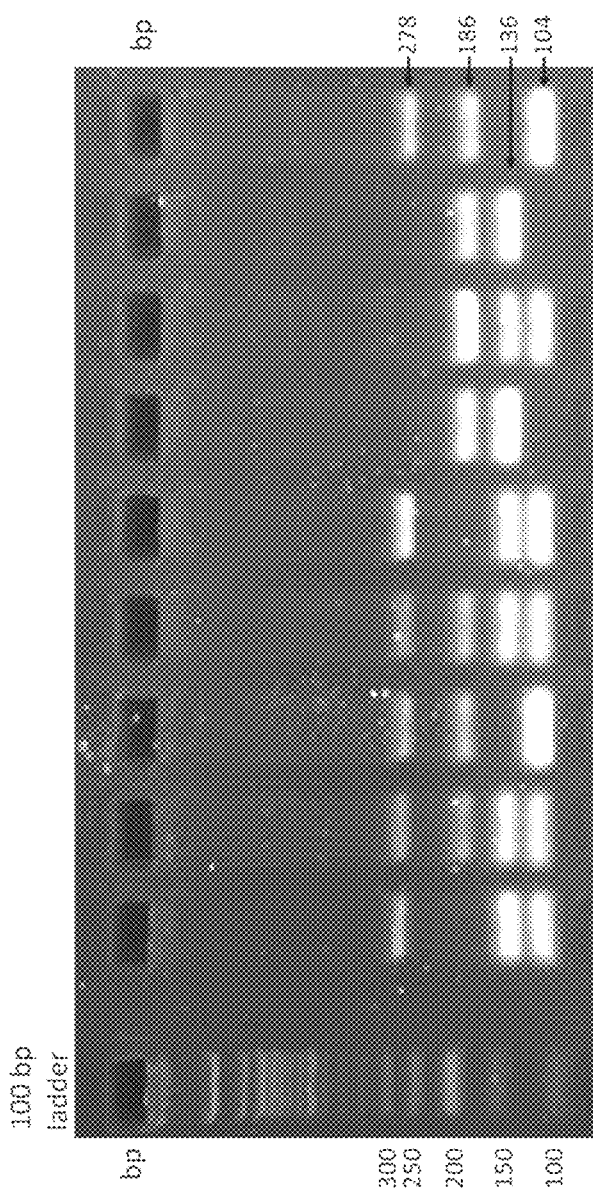
FIG. 17 illustrates multiplex standard PCR analysis of selfed segregating PY203 plants.

Standard PCR is analyzed by running approximately 15 µl of PCR product on a 3% agarose gel at 95V for 30 min. An example of results from a standard PCR analysis of selfed segregating PY203 plants is shown in FIG. 17. Referring to this figure, nine PCR reactions from nine independent plants were separated on a 3% agarose gel stained with ethidium bromide. Left panel corresponds to 100 bp ladder; lane 1: null for 3293 and hemizygous for 3507; lane 2; hemizygous for 3293 and hemizygous for 3507; lane 3: hemizygous for 3293 and null for 3507; lane 4: hemizygous for 3293 and hemizygous for 3507; lane 5: null for 3293 and hemizygous for 3507; lane 6: homozygous for 3293 and homozygous for 3507; lane 7: homozygous for 3293 and hemizygous for 3507; lane 8: homozygous for 3293 and homozygous for 3507; and lane 9: hemizygous for 3293 and null for 3507

Expected locus and zygosity band sizes are indicated on the right side of the image. Locus presence and zygosity was scored by visualizing specific bands in each lane.

Real-Time PCR was performed with 2 µl of DNA extract in 20 µl reaction volumes with the following components and conditions for each event:

PY15 Standard PCR:
Components (final concentration): PCR Mix with buffer, MgCl$_2$, nucleotides, and enzyme (1×); Primer 580 (400 nM); Primer 688 (400 nM); Primer 732 (400 nM); Probe PB10 (200 nM); Probe PB11 (200 nM)
Conditions: 95° C., 4 min; 40 cycles (95° C., 5 sec; 60° C., 45 sec)

PY203 Standard PCR:
Reaction Components (final concentration): PCR Mix with buffer, MgCl$_2$, nucleotides, and enzyme (1×); Primer 504 (300 nM); Primer 696 (300 nM); Primer 620 (300 nM); Primer 747 (600 nM); Primer 753 (600 nM); Probe PB6 (200 nM); Probe PB8 (200 nM); Probe PB9 (200 nM); Probe PB14 (200 nM)
Conditions: 95° C., 4 min; 45 cycles (95° C., 5 sec; 60° C., 60 sec)

Figure 18:
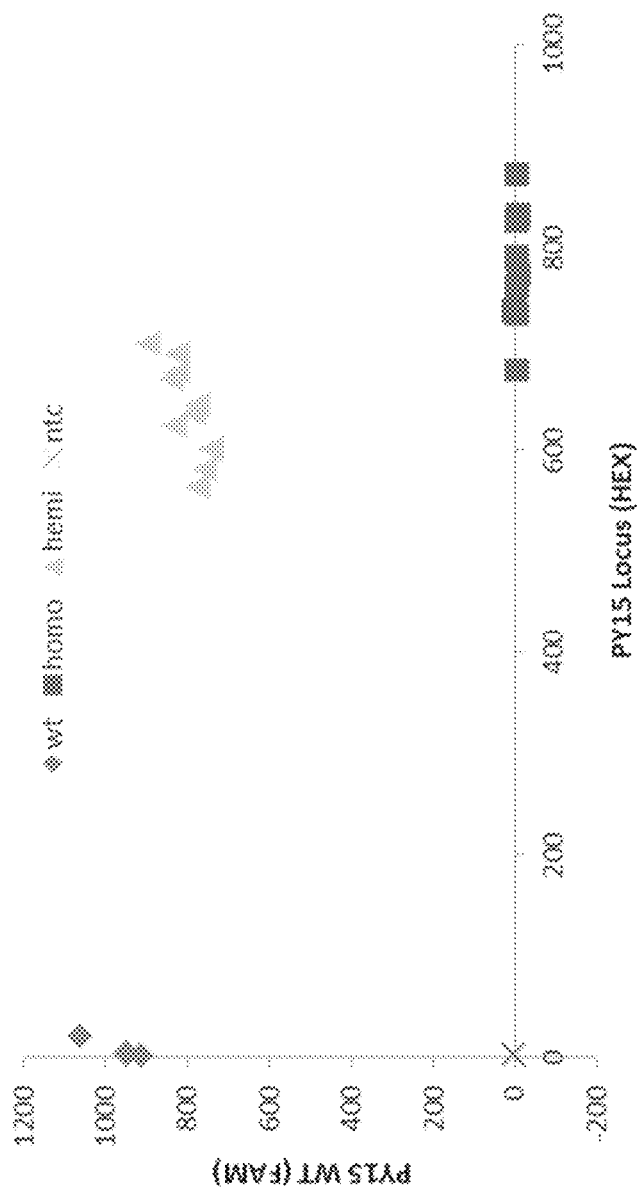
FIG. 18 illustrates real-time PCR analysis of selfed segregating PY15 plants.

Real-Time PCR can be analyzed by any real-time PCR machine and software capable of four-channel fluorescence detection. A Bio-Rad CFX96 real-time PCR machine and CFX Manager Software were used to run an example of the PY15 real-time PCR assay on a selfed segregating population of PY15 plants as shown on FIG. 18. FIG. 18 illustrates real-time PCR analysis of selfed segregating PY15 plants. X and Y axes represent relative fluorescence units (RFUs) for each probe. Each data point represents an individual PCR reaction and/or plant. In this figure, "wt" refers to wild type; "homo" refers to homozygous; "hemi" refers to hemizygous; "ntc" refers to no target control. PY15 locus presence and zygosity was scored by the clustering of data points on the graph.

Figure 19:
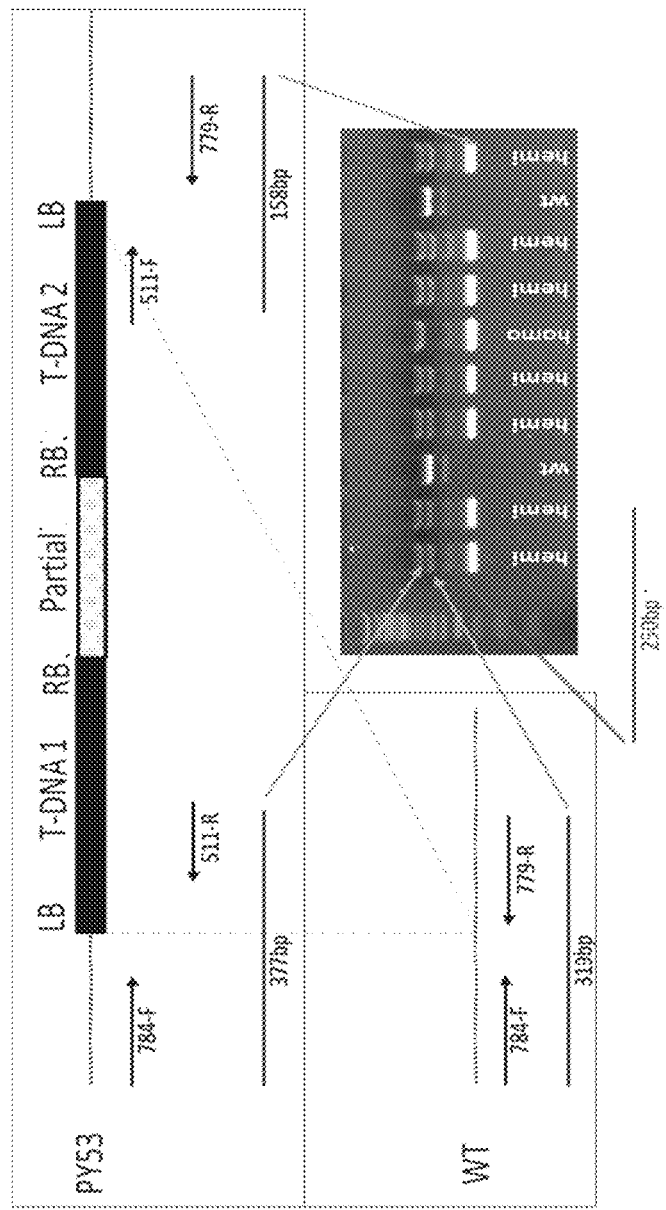
FIG. 19 illustrates PY53 standard gel-based PCR assay design and example data.
Figure 20:
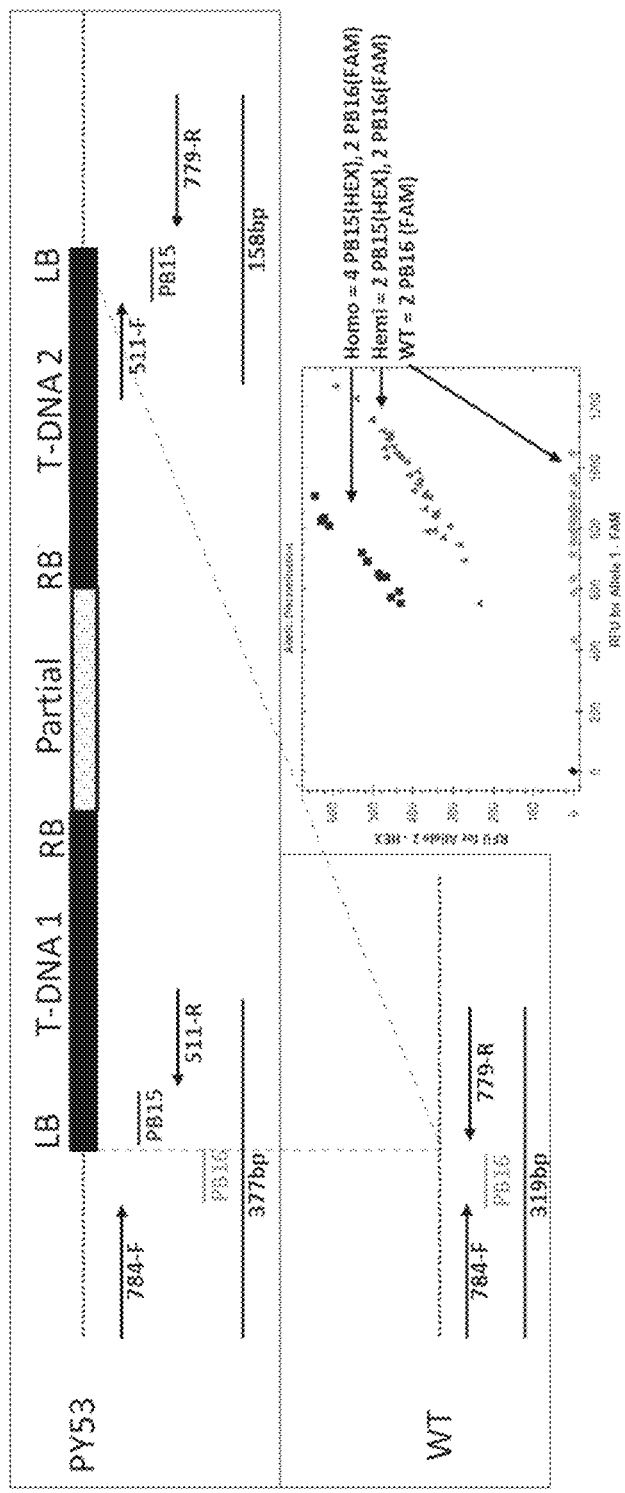
FIG. 20 illustrates PY53 real-time PCR assay design and example data.

PY53 Event:
Maize phytase event PY53 (4281_53) carries transgenes that result in seed-specific expression of phytase enzyme. PY53 carries multiple T-DNAs at a single genetic locus. Molecular identification and tracking of the PY53 locus can be done using standard (endpoint gel-based) PCR or real-time PCR. In addition to determining whether a plant is carrying a transgene, these assays can also determine whether a plant is hemizygous (carrying one copy of the insertion) or homozygous (carrying two copies of the insertion). With the PY53 locus, two locus bands are expected and amplified in a multiplex standard PCR reaction as shown in FIG. 19 and a multiplex real time PCR reaction as shown in FIG. 20. There is also one PCR fragment that is amplified from an unknown (and presumably unrelated) genomic location (currently being characterized) that does not interfere with the ability to determine locus presence and zygosity in the gel-based assay (FIG. 19) or the real-time PCR assay (FIG. 20; similar results were observed between both assays with identical samples).

PCR
PY53 standard and real-time PCR primers are listed in Table 19 and standard PCR primer combinations with expected PCR product sizes are listed in Table 20.

TABLE 19

Standard and Real-time (RT) PCR Primers and Probes
Used to Determine T-DNA Locus Presence and Zygosity of the PY53 Event

| PCR Assay | Event | Primer or Probe | Primer/ Probe ID | Primer Sequence | Fluor* | Quencher |
|---|---|---|---|---|---|---|
| Standard/ RT | PY53 | Primer | 511 | GCGCGGTGTCATCTATG TTA (SEQ ID NO: 119) | | |
| Standard/ RT | PY53 | Primer | 779 | GAGCCCGATCCTAATCC AATC (SEQ ID NO: 120) | | |
| Standard/ RT | PY53 | Primer | 784 | GCCTTGTAGCCTTCTTG AGTAT (SEQ ID NO: 121) | | |
| RT | PY53 | Probe | PB15 (loc)** | ATCTCGCCACCTCTTCC ACATCAC (SEQ ID NO: 122) | HEX | BHQ1 |
| RT | PY53 | Probe | PB16 (zyg)*** | TGTGATGATGTGGTCTG GTTGGGC (SEQ ID NO: 123) | FAM | BHQ1 |

*-"Fluor" means fluorophore
**-"loc" means locus target
***-"zyg" means zygosity target

TABLE 20

PY53 Event and Locus-specific PCR Primer Combinations and PCR Product Sizes

| Event | Locus | Primer A | Primer B | Primer C | PCR Product (bp) | Assay Identifies |
|---|---|---|---|---|---|---|
| PY53 | PY53 | 784 | 511 | | 377 | T-DNA locus (border 1) |
| PY53 | PY53 | 779 | 511 | | 158 | T-DNA locus (border 2) |
| PY53 | PY53 | 784 | | 779 | 319 | WT locus |

Standard PCR can be performed with 2 µl of DNA extract and GoTaq (Promega) PCR Mix in 30 µl reaction volumes with the following components and conditions for each event:

PY53 Standard PCR:

Components (final concentration): PCR Mix with buffer, MgCl$_2$, nucleotides, and enzyme (1×); Primer 511 (400 nM); Primer 779 (400 nM); Primer 784 (400 nM).

Conditions: 95° C., 3 min; 33 cycles (95° C., 30 sec; 60° C., 30 sec; 72° C., 30 sec); 72° C., 8 min Standard PCR is analyzed by running approximately 15 µl of PCR product on a 3% agarose gel at 95V for 30 min. An example of results from a standard PCR analysis of event PY53 is shown in FIG. 19. Locus presence and zygosity is scored by visualizing specific bands in each lane.

Real-Time PCR is performed with 2 µl of DNA extract in 20 µl reaction volumes with the following components and conditions for each event:

PY53 Real Time PCR:

Components (final concentration): PCR Mix with buffer, MgCl$_2$, nucleotides, and enzyme (1×); Primer 511 (400 nM); Primer 779 (400 nM); Primer 784 (400 nM); Probe PB15 (200 nM); and Probe PB16 (200 nM).

Conditions: 95° C., 4 min; 40 cycles (95° C., 5 sec; 60° C., 45 sec).

Real-Time PCR can be analyzed by any real-time PCR machine and software capable of two-channel fluorescence detection. A Bio-Rad CFX96 real-time PCR machine and CFX Manager Software were used to run an example of the PY53 real-time PCR assay on a selfed segregating population of PY53 plants (FIG. 20). PY53 locus presence and zygosity is scored by the clustering of data points on the graph.

PY209 Event (4295_209):

Maize phytase event PY209 was created by a T-DNA inserted in chromosome 4. Molecular identification and tracking of the PY209 locus can be done using standard (endpoint gel-based) PCR or real-time PCR. In addition to determining whether a plant is carrying a transgene, these assays can also determine whether a plant is hemizygous (carrying one copy of the insertion) or homozygous (carrying two copies of the insertion).

PCR

PY209 standard and real-time PCR primers are listed in Table 21 and standard PCR primer combinations with expected PCR product sizes are listed in Table 22.

TABLE 21

Standard and Real-time (RT) PCR Primers and Probes
Determine T-DNA Locus Presence and Zygosity of the PY209

| PCR Assay | Event | Primer or Probe | Primer/ Probe ID | Primer Sequence |
|---|---|---|---|---|
| Standard/ RT | | Primer | 456 (loc)* | GGCGAGCTCGAATTAATTC AGTAC (SEQ ID NO: 160) |

TABLE 21-continued

Standard and Real-time (RT) PCR Primers and Probes
Determine T-DNA Locus Presence and Zygosity of the PY209

| PCR Assay | Event | Primer or Probe | Primer/ Probe ID | Primer Sequence |
|---|---|---|---|---|
| Standard/ RT | PY209 | Primer | 513 (loc)* | AAACGTCCGCAATGTGTTA TT (SEQ ID NO: 161) |
| Standard/ RT | | Probe | PB15 (loc)* | CCGCAATGTGTTATTAAGT TGTCTAAGCGT (SEQ ID NO: 122) |
| Standard/ RT | PY209 | Probe | PB22 (zyg)* | CACAGATACTCCATATGCA ACTTAGGTACAGC (SEQ ID NO: 163) |
| Standard/ RT | PY209 | Primer | 889 (zyg)** | AGGTCCAGGTTGTATCAGTGA (SEQ ID NO: 164) |
| Standard/ RT | PY209 | Primer | 909 (zyg)** | GAGATCGCTGCAGAGTGC (SEQ ID NO: 165) |

*-"loc" means locus target
**-"zyg" means zygosity target

TABLE 22

PY209 event and locus-specific PCR primer combinations and PCR product sizes

| Event | Locus | Primer A | Primer B | PCR Product (bp) | Assay Identifies |
|---|---|---|---|---|---|
| PY209 | PY209loc | 513 | 889 | 112 | T-DNA locus (border 1) |
| PY209 | PY209zyg | 889 | 909 | 141 | WT locus |
| PY209 | PY209loc | 456 | 889 | 138 | T-DNA locus |
| PY209 | PY209zyg | 889 | 909 | 129 | WT locus |

Standard PCR can be performed with 2 µl of DNA extract and GoTaq (Promega) PCR Mix in 30 µl reaction volumes with the following components and conditions for each event:

PY209 Standard PCR:

Components (final concentration): PCR Mix with buffer, MgCl$_2$, nucleotides, and enzyme (1×); Primer 513 (400 nM); Primer 889 (200 nM); Primer 909 (200 nM).

Conditions: 95° C., 3 min; 33 cycles (95° C., 30 sec; 60° C., 30 sec; 72° C., 30 sec); 72° C., 8 min Standard PCR is analyzed by running approximately 10 µl of PCR product on a 3% agarose gel at 95V for 30 min. Locus presence and zygosity is scored by visualizing specific bands in each lane.

Real-Time PCR is performed with 2 µl of DNA extract in 20 µl reaction volumes with the following components and conditions for each event:

PY209 Real Time PCR:

Components (final concentration): PCR Mix with buffer, MgCl$_2$, nucleotides, and enzyme (1×); Primer 456 (400 nM); Primer 889 (400 nM); Primer 909 (400 nM); Probe PB15 (200 nM); Probe PB22 (200 nM).

Conditions: 95° C., 4 min; 40 cycles (95° C., 5 sec; 60° C., 45 sec).

Real-Time PCR can be analyzed by any real-time PCR machine and software capable of two-channel fluorescence detection. A Bio-Rad CFX96 real-time PCR machine and CFX Manager Software were used to run an example of the PY209 real-time PCR assay on a selfed segregating population of PY209 plants. PY209 locus presence and zygosity is scored by the clustering of data points on the graph.

Figure 21:
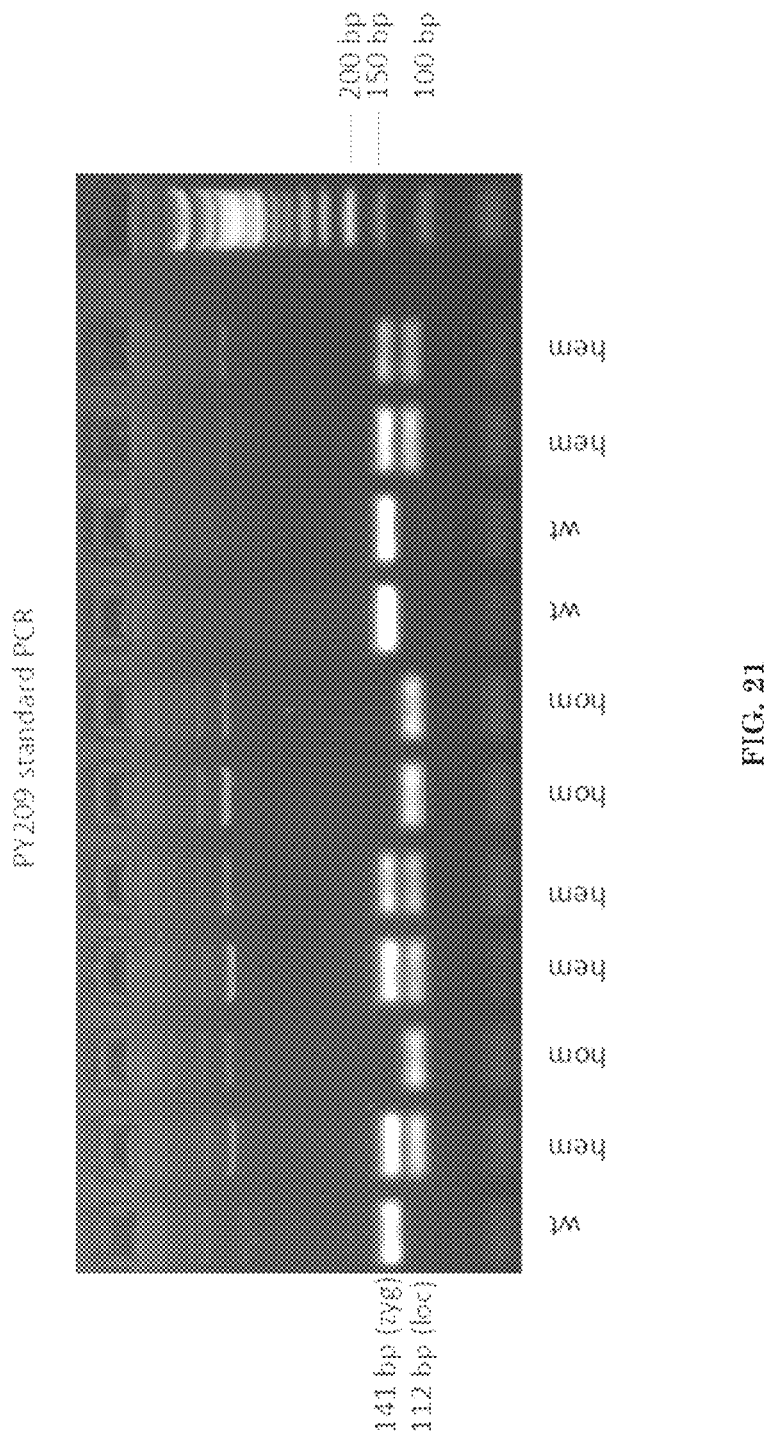
FIG. 21 illustrates multiplex standard PCR analysis of selfed segregating PY209.

An example of results from a standard PCR analysis of selfed segregating PY209 plants is shown in FIG. 21. Referring to this figure, 11 PCR reactions from eleven independent plants were separated on a 3% agarose gel stained with ethidium bromide. Expected locus and zygosity band sizes are indicated on the respective left and right sides of the image. Locus presence and zygosity was scored by visualizing specific bands in each lane.

PY 1053 (4915 1053) and PY1203 (4916_1203) Event:

Both maize phytase events PY1053 and PY1203 are expected to carry at least two T-DNAs. Molecular identification and tracking of the PY1053 locus and PY1203 locus can be done using standard (endpoint gel-based) PCR or real-time PCR. In addition to determining whether a plant is carrying a transgene, these assays can also determine whether a plant is hemizygous (carrying one copy of the insertion) or homozygous (carrying two copies of the insertion).

PCR

PY1053 and PY1203 standard and real-time PCR primers are listed in Table 23 and standard PCR primer combinations with expected PCR product sizes are listed in Table 24.

TABLE 23

Standard and real-time (RT) PCR primers and probes used to determine T-DNA locus presence and zygosity of the PY1053 and PY1203 event

| PCR Assay | Event | Primer or Probe | Primer/Probe ID | Primer/Probe Sequence |
|---|---|---|---|---|
| Standard/RT | PY1053 | Primer | 925 | GGTGATGTCGTACGCTTGT (SEQ ID NO: 166) |
| Standard/RT | PY1053 | Primer | 926 | AGCTGTAAAGTCATTCGAG GATAG (SEQ ID NO: 167) |
| Standard/RT | PY1053 | Primer | 505 | TGTTACTAGATCGGGAAT TGGC (SEQ ID NO: 168) |
| Standard/RT | PY1203 | Primer | 456 | GGCGAGCTCGAATTAAT TCAGTAC (SEQ ID NO: 160) |
| Standard/RT | PY1053/PY1203 | Probe | PB15 | CCGCAATGTGTTATTAAG TTGTCTAAGCGT (SEQ ID NO: 122) |
| Standard/RT | PY1203 | Probe | PB21 | ACGATTCTGTCCTGGTCA CTGC (SEQ ID NO: 162) |
| Standard/RT | PY1053 | Probe | PB23 | CTCTCTCTCTCCTTTTCA TGGCTCTTTTGTTT (SEQ ID NO: 169) |
| Standard/RT | PY1053 | Primer | 513 (loc)* | AAACGTCCGCAATGTGTT ATT (SEQ ID NO: 161) |
| Standard/RT | PY1203 | Primer | 908 (loc)* | ATACTAAAAAGGCACGA CCGTC (SEQ ID NO: 170) |
| Standard/RT | PY1203 | Primer | 890 (loc)* | TGGTCAAGATAGGTGGC TTCT (SEQ ID NO: 171) |
| Standard/RT | PY1203 | Primer | 855 (loc)* | ATGATTAGAGTCCCGCA ATTATACA (SE ID NO: 172) |
| Standard/RT | PY1053 | Primer | 886 (zyg)** | TCCCTCTCCATTCCTCCT TT (SEQ ID NO: 173) |
| Standard/RT | PY1053 | Primer | 887 (zyg)** | CGCTCGAATTGTTGCATG TT (SEQ ID NO: 174) |

*-"loc" means locus target
**-"zyg" means zygosity target

TABLE 24

PY1053 and PY1203 event and locus-specific PCR primer combinations and PCR product sizes

| Event | Locus | Primer A | Primer B | PCR Product (bp) | Assay Identifies |
|---|---|---|---|---|---|
| PY1053 | PY1053 loc1 | 513 | 887 | 179 | T-DNA locus1 (border 1) |
| PY1053 | PY1053 loc2 | 513 | 886 | 227 | T-DNA locus2 (border 2) |
| PY1053 | PY1053 zyg | 886 | 887 | 296 | WT locus |
| PY1053 | PY1053 loc | 505 | 925 | 159 | T-DNA locus |
| PY1053 | PY1053 zyg | 925 | 926 | 190 | WT locus |
| PY1203 | PY1203 loc1 | 855 | 890 | 228 | T-DNA locus1 (border 1) |
| PY1203 | PY1203 zyg | 908 | 890 | 119 | WT locus |
| PY1203 | PY1203 loc2 | 855 | 908 | 182 | T-DNA locus2 (border 1) |
| PY1203 | PY1203 zyg | 890 | 908 | 87 | WT locus |
| PY1203 | PY1203 loc | 456 | 890 | 112 | T-DNA locus (border) |

Standard PCR can be performed with 2 µl of DNA extract and GoTaq (Promega) PCR Mix in 30 µl reaction volumes with the following components and conditions for each event:

PY1053 Standard PCR:
Components (final concentration): PCR Mix with buffer, $MgCl_2$, nucleotides, and enzyme (1×); Primer 513 (400 nM); Primer 886 (400 nM); Primer 887 (400 nM).
Conditions: 95° C., 3 min; 33 cycles (95° C., 30 sec; 60° C., 30 sec; 72° C., 30 sec); 72° C., 8 min.

PY1203 Standard PCR:

Components (final concentration): PCR Mix with buffer, MgCl$_2$, nucleotides, and enzyme (1×); Primer 513 (400 nM); Primer 890 (400 nM); Primer 908 (400 nM).

Conditions: 95° C., 3 min; 33 cycles (95° C., 30 sec; 60° C., 30 sec; 72° C., 30 sec); 72° C., 8 min.

Standard PCR is analyzed by running approximately 15 µl of PCR product on a 3% agarose gel at 95V for 30 min. Locus presence and zygosity is scored by visualizing specific bands in each lane.

Figure 22:
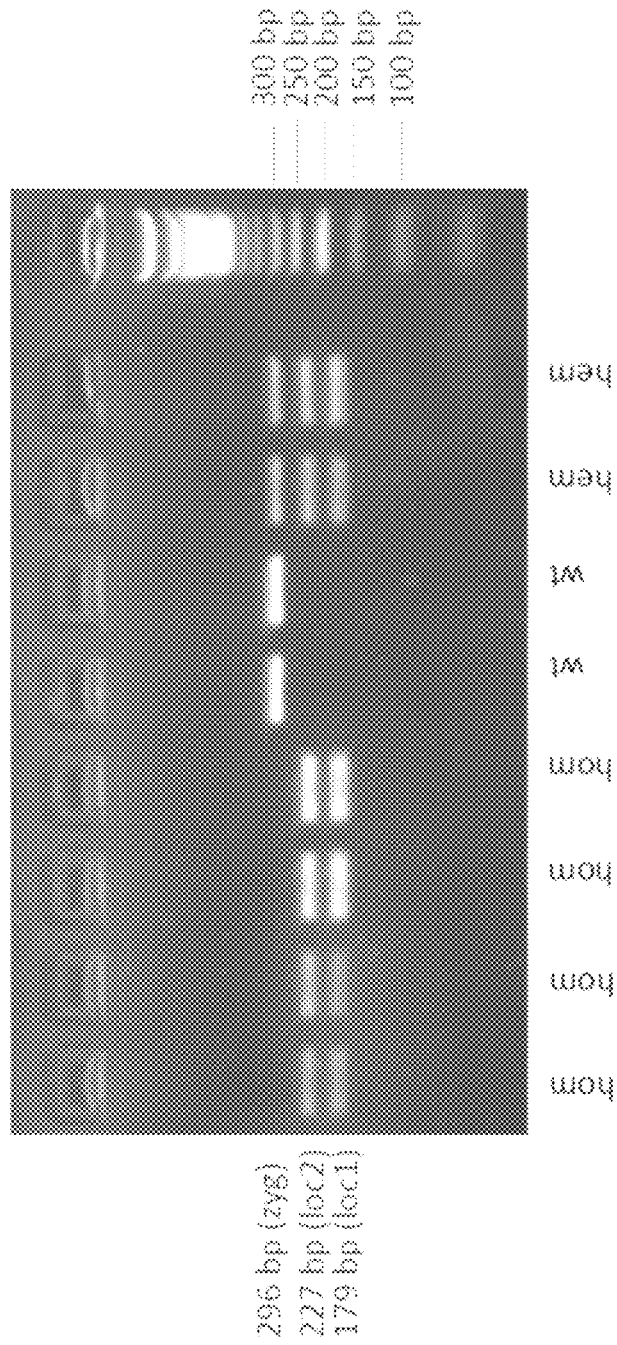
FIG. 22 illustrates multiplex standard PCR analysis of selfed segregating PY1053.
Figure 23:
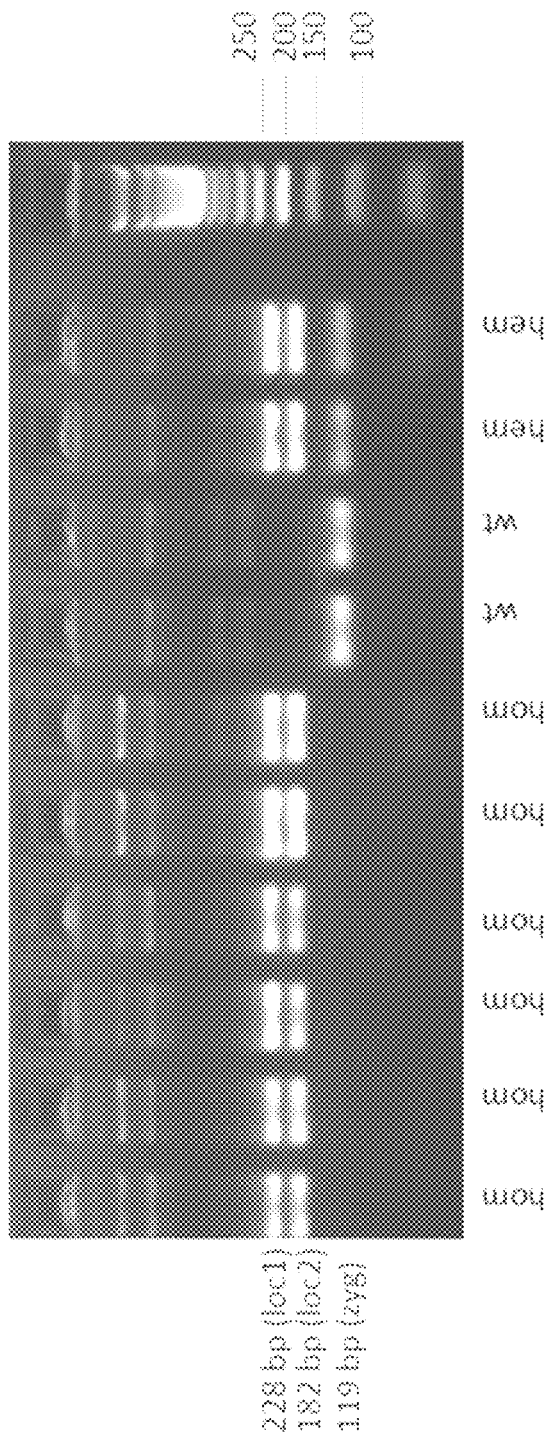
FIG. 23 illustrates multiplex standard PCR analysis of selfed segregating PY1203.

An example of results from a standard PCR analysis of selfed segregating PY1053 and PY1203 plants are shown in respective FIGS. 22 and 23. Referring to FIG. 22, eight PCR reactions from eight independent plants were separated on a 3% agarose gel stained with ethidium bromide. Referring to FIG. 23, ten PCR reactions from ten independent plants were separated on a 3% agarose gel stained with ethidium bromide. Referred to these figures, expected locus and zygosity band sizes are indicated on the respective left and right sides of the image. Locus presence and zygosity was scored by visualizing specific bands in each lane.

Real-Time PCR is performed with 2 µl of DNA extract in 20 µl reaction volumes with the following components and conditions for each event:

PY1053 Real Time PCR:

Components (final concentration): PCR Mix with buffer, MgCl$_2$, nucleotides, and enzyme (1×); Primer 505 (400 nM); Primer 925 (400 nM); Primer 926 (400 nM); Probe PB15 (200 nM); Probe PB23 (200 nM).

Conditions: 95° C., 4 min; 40 cycles (95° C., 5 sec; 60° C., 45 sec)

Real-Time PCR can be analyzed by any real-time PCR machine and software capable of two-channel fluorescence detection. A Bio-Rad CFX96 real-time PCR machine and CFX Manager Software were used to run an example of the PY1053 real-time PCR assay on a selfed segregating population of PY1053 plants. PY1053 locus presence and zygosity is scored by the clustering of data points on the graph.

PY1203 Real Time PCR:

Components (final concentration): PCR Mix with buffer, MgCl$_2$, nucleotides, and enzyme (1×); Primer 456 (400 nM); Primer 890 (400 nM); Primer 908 (400 nM); Probe PB15 (200 nM); Probe PB21 (200 nM).

Conditions: 95° C., 4 min; 40 cycles (95° C., 5 sec; 60° C., 45 sec)

Real-Time PCR can be analyzed by any real-time PCR machine and software capable of two-channel fluorescence detection. A Bio-Rad CFX96 real-time PCR machine and CFX Manager Software were used to run an example of the PY1203 real-time PCR assay on a selfed segregating population of PY1203 plants. PY1203 locus presence and zygosity is scored by the clustering of data points on the graph.

Example 9. Expressing Codon Optimized Phy02 Sequence

Enhanced expression of phytase in transgenic grain can provide an added value to the final product by lowering the necessary acreage required to produce any specified amount of protein (or a specified number of phytase units (FTUs)), thereby reducing the operations required for identity preservation of the grain, and by reducing the amount of necessary storage and transportation per unit of phytase activity, all of which lower the cost per dose of phytase in formulated feed. Comparative analysis of phytase expression in transgenic seed revealed that the median level of Nov9x phytase expression in transgenic lines, as it is assessed by phytase protein specific activity, is higher and reaches up to 5000 FTU/g in the best hemizygous Nov9x expressors in the contrast to Phy-02 expression from otherwise identical constructs. Comparison of the coding DNA for Nov9x and Phy-02 demonstrated significant divergence of nucleotide sequences with only 85.6% sequence identity between the two sequences. These differences provided an opportunity for the enhancement of phytase gene expression by optimizing the DNA sequence encoding Phy-02 to more closely reflect the codon usage of Nov9x as a more highly expressed gene. In total, 161 base pairs in xGZein27ss:Phy-02:SEKDEL coding DNA were replaced by Nov9x specific nucleotides, which are shown in bold and enlarged characters and underlined in the multiple sequence alignment between Nov9x, Phy-02, and resulting optimized sequence Phy-02opt (see below). The unique mutations in Phy-02 (underlined in the alignment) that are associated with improved thermostability and digestibility of the phytase protein were preserved in Phy-02opt sequence. The improved Phy-02opt was cloned into plant expression vectors pAG4913 (SEQ ID NO: 62), pAG4912 (SEQ ID NO: 70), pAG4294 (SEQ ID NO: 76), pAG4915 (SEQ ID NO: 60), pAG4916 (SEQ ID NO: 64) and pAG4295 (SEQ ID NO: 181) designed for seed specific expression and transformed into maize. The seeds from generated transgenic events were analyzed for phytase specific expression in the same manner as events expressing Nov9x or Phy-02 were analyzed. The resulting expression data demonstrate a clear improvement in Phy-02 expression from the Phy-02opt sequence, with multiple events demonstrating specific activities in hemizygous seed greater than 2500 FTU/g, some over 3700 FTU/g, and some events approaching 5000 FTU/g in hemizygous seed.

Multiple alignment of DNA coding sequences for Nov9x, Phy-02, and Phy-02opt are shown below:

```
                 1                                                  50
Nov9x     GCTGCGCAGT CCGAGCCGGA GCTGAAGCTG GAGTCCGTGG TGATCGTGTC
Phy02     ...GCCCAGA GCGAGCCGGA GCTGAAGCTG GAGAGCGTGG TGATCGTGAG
Phy02opt  GCTGCGCAGT CCGAGCCGGA GCTGAAGCTG GAGTCCGTGG TGATCGTGTC 51                                                100
Nov9x     GCGCCACGGG GTGCGCGCCC CGACCAAGGC CACGCAGCTC ATGCAGGACG
Phy02     CAGGCACGGC GTGAGGGCCC CGACCAAGTT CACCCAGCTG ATGCAGGACG
Phy02opt  GCGCCACGGG GTGCGCGCCC CGACCAAGTT CACGCAGCTC ATGCAGGACG 101                                               150
Nov9x     TGACCCCGGA CGCCTGGCCG ACCTGGCCGG TGAAGCTCGG CGAGCTGACC
Phy02     TGACCCCGGA CGCGTTCTAC ACCTGGCCGG TGAAGCTGGG CGAGCTGACC
Phy02opt  TGACCCCGGA CGCCTTCTAC ACCTGGCCGG TGAAGCTCGG CGAGCTGACC
```

-continued

```
           151                                             200
Nov9x      CCGCGCGGCG GCGAGCTGAT CGCCTACCTC GGCCACTACT GGCGCCAGCG
Phy02      CCGAGGGGCG GCGAGCTGAT CGCCTACCTG GCCACTACT GGAGGCAGAG
Phy02opt   CCGCGCGGCG GCGAGCTGAT CGCCTACCTC GGCCACTACT GGCGCCAGCG 201                                             250
Nov9x      CCTCGTGGCC GACGGCCTCC TCCCGAAGTG CGGCTGCCCG CAGTCCGGCC
Phy02      GCTGGTGGCC GACGGCCTGC TGCCGAAGAA GGGCTGCCCG CAGAGCGGCC
Phy02opt   CCTCGTGGCC GACGGCCTCC TCCCGAAGAA GGGCTGCCCG CAGTCCGGCC 251                                             300
Nov9x      AGGTGGCGAT CATCGCCGAC GTGGACGAGC GCACCCGCAA GACGGGCGAG
Phy02      AGGTGGCCAT CATCGCCGAC GTGGACGAGA GGACCAGGAA GACCGGTGAG
Phy02opt   AGGTGGCGAT CATCGCCGAC GTGGACGAGC GCACCCGCAA GACGGGCGAG 301                                             350
Nov9x      GCCTTCGCCG CCGGCCTCGC CCCGGACTGC GCCATCACCG TGCACACCCA
Phy02      GCCTTCGCCG CCGGCCTGGC CCCGGACTGC GCCATCACCG TGCACACCCA
Phy02opt   GCCTTCGCCG CCGGCCTCGC CCCGGACTGC GCCATCACCG TGCACACCCA 351                                             400
Nov9x      GGCCGACACC TCCTCCCCGG ACCCGCTCTT CAACCCGCTC AAGACCGGCG
Phy02      GGCCGACACC AGCAGCCCGG ACCCGCTGTT CAACCCGCTG AAGACCGGCG
Phy02opt   GGCCGACACC TCCTCCCCGG ACCCGCTCTT CAACCCGCTC AAGACCGGCG 401                                             450
Nov9x      TGTGCCAGCT CGACAACGCC AACGTGACCG ACGCCATCCT GGAGCGCGCC
Phy02      TGTGCCAGCT GGACGTGGCC CAGGTGACCG ACGCCATCCT GGAGAGGGCC
Phy02opt   TGTGCCAGCT CGACGTGGCC CAGGTGACCG ACGCCATCCT GGAGCGCGCC 451                                             500
Nov9x      GGCGGCTCCA TCGCCGACTT CACCGGCCAC TACCAGACCG CCTTCCGCGA
Phy02      GGCGGGAGCA TCGCCGACTT CACCGGCCAC TACCAGACCG CCTTCAGGGA
Phy02opt   GGCGGCTCCA TCGCCGACTT CACCGGCCAC TACCAGACCG CCTTCCGCGA 501                                             550
Nov9x      GCTGGAGCGC GTGCTCAACT TCCCGCAGTC GAACCTCTGC CTCAAGCGCG
Phy02      GCTGGAGAGG GTGCTGAACT TCCCGCAGAG CAACCTGGCC CTGAAGAGGG
Phy02opt   GCTGGAGCGC GTGCTCAACT TCCCGCAGTC GAACCTCGCC CTCAAGCGCG 551                                             600
Nov9x      AGAAGCAGGA CGAGTCCTGC TCCCTCACCC AGGGCCCTCCC GTCCGAGCTG
Phy02      AGAAGCAGGA CGAGAGCGCC AGCCTGACCC AGGGCCCTGCC GAGCGAGCTG
Phy02opt   AGAAGCAGGA CGAGTCCGCC TCCCTCACCC AGGGCCCTCCC GTCCGAGCTG 601                                             650
Nov9x      AAGGTGTCCG CCGACTGCGT GTCCCTCACC GGCGCCGTGT CCCTCGCCTC
Phy02      AAGGTGAGCG CCGACAACGT GAGCCTGACC GGCGCCTGGA GCCTGGCCAG
Phy02opt   AAGGTGTCCG CCGACAACGT GTCCCTCACC GGCGCCTGGT CCCTCGCCTC 651                                             700
Nov9x      CATGCTCACC GAAATCTTCC TCCTCCAGCA GGCCCAGGGC ATGCCGGAGC
Phy02      CATGCTGACC GAGATTTTCC TGCTGCAGCA GGCCCAGGGC ATGCCGGAGC
Phy02opt   CATGCTCACC GAAATCTTCC TCCTCCAGCA GGCCCAGGGC ATGCCGGAGC 701                                             750
Nov9x      CGGGCTGGGG CCGCATCACC GACTCCCACC AGTGGAACAC CCTCCTCTCC
Phy02      CGGGCTGGGG CAGGATCACC GACAGCCACC AGTGGAACAC CCTGCTGAGC
Phy02opt   CGGGCTGGGG CCGCATCACC GACTCCCACC AGTGGAACAC CCTCCTCTCC 751                                             800
Nov9x      CTCCACAACG CCCAGTTCGA CCTCCTCCAG CGCACCCCGG AGGTGGCCCG
Phy02      CTGCACAACG CCCAGTTCGA CCTGCTGCAG AGGACCCCGG AGGTGGCCAG
Phy02opt   CTCCACAACG CCCAGTTCGA CCTCCTCCAG CGCACCCCGG AGGTGGCCCG 801                                             850
Nov9x      CTCCCGCGCC ACCCCGCTCC TCGACCTCAT CAAGACCGCC CTCACCCCGC
Phy02      GAGCAGGGCC ACCCCGCTGC TGGACCTGAT CAAGACCGCC CTGACCCCGC
Phy02opt   CTCCCGCGCC ACCCCGCTCC TCGACCTCAT CAAGACCGCC CTCACCCCGC 851                                             900
Nov9x      ACCCGCCGCA GAAGCAGGCC TACGGCGTGA CCCTCCCGAC CTCGGTGCTC
Phy02      ACCCGCCGCA GAAGCAGGCC TACGGCGTGA CCCTGCCGAC CAGCGTGCTG
Phy02opt   ACCCGCCGCA GAAGCAGGCC TACGGCGTGA CCCTCCCGAC CTCGGTGCTC
```

```
             901                                                  950
Nov9x        TTCATCGCCG GCCACGACAC CAACCTCGCC AACCTCGGCG GCGCCCTGGA
Phy02        TTCATCGCCG GCCACGACAC CAACCTGGCC AACCTGGGCG GCGCCCTCGA
Phy02opt     TTCATCGCCG GCCACGACAC CAACCTCGCC AACCTCGGCG GCGCCCTGGA 951                                                 1000
Nov9x        GCTGAACTGG ACCCTCCCGG GCCAGCCGGA CAACACCCCG CCGGGCGGCG
Phy02        GCTGCAGTGG ACCCTGCCGG GCCAGCCGGA CAACACCCCG CCGGGCGGCG
Phy02opt     GCTGCAGTGG ACCCTCCCGG GCCAGCCGGA CAACACCCCG CCGGGCGGCG 1001                                                1050
Nov9x        AGCTGGTGTT CGAGCGCTGG CGCCGCCTCT CCGACAACTC CCAGTGGATT
Phy02        AGCTGGTGTT CGAGAGGTGG AGGAGGCTGA GCGACAACAG CCAGTGGATT
Phy02opt     AGCTGGTGTT CGAGCGCTGG CGCCGCCTCT CCGACAACTC CCAGTGGATT 1051                                                1100
Nov9x        CAGGTGTCCC TCGTGTTCCA GACCCTCCAG CAGATGCGCG ACAAGACCCC
Phy02        CAGGTGAGCC TGGTGTTCCA GACCCTGCAG CAGATGAGGG ACAAGACCCC
Phy02opt     CAGGTGTCCC TCGTGTTCCA GACCCTCCAG CAGATGCGCG ACAAGACCCC 1101                                                1150
Nov9x        GCTCTCCCTC AACACCCCGC CGGGCGAGGT GAAGCTCACC CTGGCCGGCT
Phy02        GCTGTTCCTG AACACCCCGC CGGGCGAGGT GAAGCTGACC CTGGCCGGCT
Phy02opt     GCTCTTCCTC AACACCCCGC CGGGCGAGGT GAAGCTCACC CTGGCCGGCT 1151                                                1200
Nov9x        GCGAGGAGCG CAACGCGCAG GGCATGTGCT CCCTCGCCGG CTTCACCCAG
Phy02        GCGAGGAGAG GAACGCCCAG GGCATGTGCA GCCTGGCCGG CTTCACCCAG
Phy02opt     GCGAGGAGCG CAACGCGCAG GGCATGTGCT CCCTCGCCGG CTTCACCCAG 1201                            1239
Nov9x        ATCGTGAACG AGGCCCGCAT CCCGGCCTGC TCCCTCTAA (SEQ ID NO: 21)
Phy02        ATCGTGAACG AGGCCAGGAT TCCGGCCTGC AGCCTGTGA (SEQ ID NO: 15)
Phy02opt     ATCGTGAACG AGGCCCGCAT CCCGGCCTGC TCCCTCTAA (SEQ ID NO: 17)
```

REFERENCES

Arakawa, T., Chong, D. K., & Langridge, W. H. (1998). Efficacy of a food plant-based oral cholera toxin B subunit vaccine. *Nature Biotechnology*, 16(3), 292-297. doi: 10.1038/nbt0398-292

Basu, S. S., Winslow, S., Nelson, A., Ono, M., & Betts, S. (2009). EXTRACTION METHODS AND ASSAYS FOR FEED ENZYMES.

Cervelli, M., Di Caro, O., Di Penta, A., Angelini, R., Federico, R., Vitale, A., & Mariottini, P. (2004). A novel C-terminal sequence from barley polyamine oxidase is a vacuolar sorting signal. *Plant Journal*, 40(3), 410-418. doi: 10.1111/j.1365-313X.2004.02221.X Haq, T. a, Mason, H. S., Clements, J. D., & Arntzen, C. J. (1995). Oral immunization with a recombinant bacterial antigen produced in transgenic plants. *Science* (New York, N.Y.), 268(5211), 714-716. doi:10.1126/science.7732379

Lawrence, C J, Dong, Q, Polacco, M L, Seigfried, T E, and Brendel, V. (2004) MaizeGDB, the community database for maize genetics and genomics. *Nucleic Acids Research* 32:D393-D397.

Korban, S. S. (2002). Targeting and expression of antigenic proteins in transgenic plants for production of edible oral vaccines. *In Vitro Cellular & Developmental Biology—Plant*, 38(3), 231-236. doi:10.1079/IVP2002292

Munro, S., & Pelham, H. R. (1987). A C-terminal signal prevents secretion of luminal ER proteins. *Cell*, 48(5), 899-907. doi:10.1016/0092-8674(87)90086-9

The references cited throughout this application, are incorporated for all purposes apparent herein and in the references themselves as if each reference was fully set forth. For the sake of presentation, specific ones of these references are cited at particular locations herein. A citation of a reference at a particular location indicates a manner(s) in which the teachings of the reference are incorporated. However, a citation of a reference at a particular location does not limit the manner in which all of the teachings of the cited reference are incorporated for all purposes.

It is understood, therefore, that this invention is not limited to the particular embodiments disclosed, but is intended to cover all modifications which are within the spirit and scope of the invention as defined by the appended claims; the above description; and/or shown in the attached drawings.

SEQUENCE LISTING (185 sequences)

SEQ ID NO: 1 - DNA, 2000 bp, Zea mays
  promoter (1)..(2000): Maize oleosin 16
ataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctacc

SEQ ID NO: 2 - DNA, 1299 bp, Zea mays
  promoter (1)..(1299): Maize PEP carboxylase
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgcc

SEQ ID NO: 3 - DNA, 1992 bp, Zea mays
  promoter (1)..(1992): Maize ubiquitin 1 (with intron)
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcag

SEQ ID NO: 4 - DNA, 1363 bp, Zea mays
  promoter (1)..(1363): Maize gamma zein 27
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacacc

SEQ ID NO: 5 - DNA, 2071 bp, Oryza sativa
  promoter (1)..(2071): Rice glutelin 1
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaac

SEQ ID NO: 6 - DNA, 1474 bp, Oryza sativa
  promoter (1)..(1474): Rice glutelin B4
tacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagct

SEQ ID NO: 7 - DNA, 57 bp, Zea mays
  sig_peptide (1)..(57): Maize gamma zein 27_Coding sequence
atgcgcgtgctgctcgtggccctggccctgctggctcttgctgccagcgccacctct

SEQ ID NO: 8 - protein, 19 aa, Zea mays
  SIGNAL (1)..(19): Maize gamma zein 27_polypeptide
MRVLLVALALLALAASATS

SEQ ID NO: 9 - DNA, 72 bp, Oryza sativa
  sig_peptide (1)..(72): Rice glutelin B4_coding sequence
atggccaccatcgctttctcccgcttgtccatctacttctgcgtgcttctcctgtgccacggctccatggcc

SEQ ID NO: 10 - protein, 24 aa, Oryza sativa
  SIGNAL (1)..(24): Rice glutelin B4_polypeptide
MATIAFSRLSIYFCVLLLCHGSMA

SEQ ID NO: 11 - DNA, 1581 bp, Artificial Sequence
  Synthetic construct, PAPhy_b1 coding seq
accgcggttcccgccgagccggcgtcgacgctgtccgggccgtcgcggccggtgacggtggcgatcggagacaggggccacgcggtggacctgccggacacggacccgcgggtgcagcgccgcgtcacgggctgggcgcccgagcagatcgccgtcgcgctctccgcctcgcccacctccgcctgggtctcctggatcacaggggactaccagatgggcggcgccgtggagccgctggaccccggcgcggtgggcagcgtcgtgcggtacggcctcgccgccgacgccctcgaccacgaggccaccggggagtcgctcgtgtacagccagctgtacccgttcgagggcctccagaactacacctccggcatcatccaccacgtccgcctccagggcctggagcctgggaccaggtacttgtaccggtgcggcgacccggccatcccggacgccatgagcgacgtgcacgcgttccgcacgatgccggccgtcgggccggggagctacccagggcggatcgccgtggtcggggacctcgggctcacctacaacaccacctcgacggtggaccacttggtgcgcaaccgccccgacctggtgctcctcctcggcgacgtctgctacgccaacctgtacctgaccaacggcaccggggcggactgctactcctgcgccttcgccaagtccacgcccatccacgagacgtaccagccgcgctgggattactggggaaggtacatggagcccgtgacgtcgagcatcccgatgatggtggtggagggcaaccatgagatcgagcagcagatccacaacaggacgttcgcggcctacagctcgcggttcgcgttcccgtcggaggagagcgggtcctcctcgccgttctactactcgttcgacgccggcggcatccacttcgtcatgcttgcgtcctacgccgactacagcagatcaggtgcgcagtacaagtggctggaggcggacctggagaaggtggacaggtcggtgacgccatggctgatcgcgggctggcacgcgccctggtacaccacctacaaggctcactacagggaagccgagtgcatgagggtggagatggaggagctcctctacgcctacggtgtcgacgtcgtcttcaccggccacgtgcacgcgtacgagcggtcgaaccgggtgttcaactacacgctggacgcgtgcggccccgtgcacatctcggtgggcgacggcggcaaccgcgagaagatggcgacggcgcacgcggacgaggcgggccactgcccggacccggcgtcgacgccggaccccttcatggggggccgcctctgcgccgccaacttcacgtcgggccccgccgcgggccgcttctgctgggaccgccagccggagtacagcgcgtacagggagagcagcttcgggcacggcgtcctggaggtcaggaacgacacgcacgcgctctggcggtggcaccgcaaccaggacctccatgccgccgccgccgccaacgtcgccgccgacgaggtctacatcgtcagggagcccgacaagtgcctcgccaagacggccagattgttggcctattga

SEQ ID NO: 12 - protein, 526 aa, Artificial Sequence
  Synthetic construct, PAPhy_b1 polypeptide
TAVPAEPASTLSGPSRPVTVAIGDRGHAVDLPDTDPRVQRRVTGWAPEQIAVALSASPTSAWVSWITGDYQMGGAVEPLDPGAVGSVVRYGLAADALDHEATGESLVYSQLYPFEGLQNYTSGIIHHVRLQGLEPGTRYLYRCGDPAIPDAMSDVHAFRTMPAVGPGSYPGRIAVVGDLGLTYNTTSTVDHLVRNRPDLVLLLGDVCYANLYLTNGTGADCYSCAFAKSTPIHETYQPRWDYWGRYMEPVTSSIPMMVVEGNHEIEQQIHNRTFAAYSSRFAFPSEESGSSSPFYYSFDAGGIHFVMLASYADYSRSGAQYKWLEADLEKVDRSVTPWLIAGWHAPWYTTYKAHYREAECMRVEMEELLYAYGVDVVFTGHVHAYERSNRVFNYTLDACGPVHISVGDGGNREKMATAHADEAGHCPDPASTPDPFMGGRLCAANFTSGPAAGRFCWDRQPEYSAYRESSFGHGVLEVRNDTHALWRWHRNQDLHAAAAANVAADEVYIVREPDKCLAKTARLLAY

SEQ ID NO: 13 - DNA, 1566 bp, Artificial Sequence
  Synthetic construct, PAPhy_b2 coding seq
gagccggcgtcgacgctgtccgggccgtcgcggccggtgacggtggcgatcggagacaggggccacgcggtggacctgccggacacggacccgcgggtgcagcgccgcgtcacgggctgggcgcccgagcagatcgccgtcgcgctctccgcctcgcccacctccgcctgggtctcctggatcacaggggactaccagatgggcggcgccgtggagccgctggaccccggcgcggtgggcagcgtcgtgcggtacggcctcgccgccgacgccctcgaccacgaggccaccggggagtcgctcgtgtacagccagctgtacccgttcgagggcctccagaactacacctccggcatcatccaccacgtccgcctccagggcctggagcctgggaccaggtacttgtaccggtgcggcgacccggccatcccggacgccatgagcgacgtgcacgcgttccgcacgatgccggccgtcgggccggggagctacccggggcggatcgccgtggtcggggacctcgggctcacctacaacaccacctcgacggtggaccacttggtgcgcaaccgccccgacctggtgctcctcctcggcgacgtctgctacgccaacctgtacctgaccaacggcaccggggcggactgctactcctgcgccttcgccaagtccacgcccatccacgagacgtaccagccgcgctgggattactggggaaggtacatggagcccgtgacgtcgagcatcccgatgatggtggtggagggcaaccatgagatcgagcagcagatccacaacaggacgttcgcggcctacagctcgcggttcgcgttcccgtcggaggagagcgggtcctcctcgccgttctactactcgttcgacgccggcggcatccacttcgtcatgcttgcgtcctacgccgactacagcagatcaggtgcgcagtacaagtggctggaggcggacctggagaaggtggacaggtcggtgacgccatggctgatcgcgggctggcacgcgccctggtacaccacctacaaggctcactacagggaagccgagtgcatgagggtggagatggaggagctcctctacgcctacggtgtcgacgtcgtcttcaccggccacgtgcacgcgtacgagcggtcgaaccgggtgttcaactacacgctggacgcgtgcggccccgtgcacatctcggtgggcgacggcggcaaccgcgagaagatggcgacggcgcacgcggacgaggccggccactgcccggacccggcgtcgacgccggaccccttcatggggggccgcctctgcgccgccaacttcacgtcgggccccgccgcgggccgcttctgctgggaccgccagccggagtacagcgcgtacagggagagcagcttcgggcacggcgtcctggaggtcaggaacgacacgcacgcgctctggcggtggcaccgcaaccaggacctccatgccgccgccgccgccaacgtcgccgccgacgaggtctacatcgtcagggagcccgacaagtgcctcgccaagacggccagattgttggcctattga

SEQ ID NO: 14 - protein, 521 aa, Artificial Sequence
  Synthetic construct,  PAPhy_b2 polypeptide
EPASTLSGPSRPVTVAIGDRGHAVDLPDTDPRVQRRVTGWAPEQIAVALSASPTSAWVSWITGDYQMGGAVEPLDPGAVGSVVRYGLAADALDHEATGESLVYSQLYPFEGLQNYTSGIIHHVRLQGLEPGTRYLYRCGDPAIPDAMSDVHAFRTMPAVGPGSYPGRIAVVGDLGLTYNTTSTVDHLVRNRPDLVLLLGDVCYANLYLTNGTGADCYSCAFAKSTPIHETYQPRWDYWGRYMEPVTSSIPMMVVEGNHEIEQQIHNRTFAAYSSRFAFPSEESGSSSPFYYSFDAGGIHFVMLASYADYSRSGAQYKWLEADLEKVDRSVTPWLIAGWHAPWYTTYKAHYREAECMRVEMEELLYAYGVDVVFTGHVHAYERSNRVFNYTLDACGPVHISVGDGGNREKMATAHADEAGHCPDPASTPDPFMGGRLCAANFTSGPAAGRFCWDRQPEYSAYRESSFGHGVLEVRNDTHALWRWHRNQDLHAAAAANVAADEVYIVREPDKCLAKTARLLAY

SEQ ID NO: 15 - DNA, 1236 bp, Artificial Sequence
  Synthetic construct, Phy-02 coding seq
gcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgtga

SEQ ID NO: 16 - protein, 411 aa, Artificial Sequence
  Synthetic construct, Phy-02 polypetide
AQSEPELKLESVVIVSRHGVRAPTKFTQLMQDVTPDAFYTWPVKLGELTPRGGELIAYLGHYWRQRLVADGLLPKKGCPQSGQVAIIADVDERTRKTGEAFAAGLAPDCAITVHTQADTSSPDPLFNPLKTGVCQLDVAQVTDAILERAGGSIADFTGHYQTAFRELERVLNFPQSNLALKREKQDESASLTQALPSELKVSADNVSLTGAWSLASMLTEIFLLQQAQGMPEPGWGRITDSHQWNTLLSLHNAQFDLLQRTPEVARSRATPLLDLIKTALTPHPPQKQAYGVTLPTSVLFIAGHDTNLANLGGALELQWTLPGQPDNTPPGGELVFERWRRLSDNSQWIQVSLVFQTLQQMRDKTPLFLNTPPGEVKLTLAGCEERNAQGMCSLAGFTQIVNEARIPACSL

SEQ ID NO: 17 - DNA, 1239 bp, Artificial Sequence
  Synthetic construct, Phy-02opt coding seq
gctgcgcagtccgagccggagctgaagctggagtccgtggtgatcgtgtcgcgccacggggtgcgcgccccgaccaagttcacgcagctcatgcaggacgtgaccccggacgccttctacacctggccggtgaagctcggcgagctgaccccgcgcggcggcgagctgatcgcctacctcggccactactggcgccagcgcctcgtggccgacggcctcctcccgaagaagggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacgtggcccaggtgaccgacgccatcctggagcgcgccggcggctccatcgccgacttcaccggccactaccagaccgccttccgcgagctggagcgcgtgctcaacttcccgcagtcgaacctcgccctcaagcgcgagaagcaggacgagtccgcctccctcacccaggccctcccgtccgagctgaaggtgtccgccgacaacgtgtccctcaccggcgcctggtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgcagtggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctcttcctcaacaccccgccgggcgaggtgaagctcaccctggccggctgcgaggagcgcaacgcgcagggcatgtgctccctcgccggcttcacccagatcgtgaacgaggcccgcatcccggcctgctccctctaa

SEQ ID NO: 18 - protein, 412 aa, Artificial Sequence
  Synthetic construct, Phy-02opt polypetide
AAQSEPELKLESVVIVSRHGVRAPTKFTQLMQDVTPDAFYTWPVKLGELTPRGGELIAYLGHYWRQRLVADGLLPKKGCPQSGQVAIIADVDERTRKTGEAFAAGLAPDCAITVHTQADTSSPDPLFNPLKTGVCQLDVAQVTDAILERAGGSIADFTGHYQTAFRELERVLNFPQSNLALKREKQDESASLTQALPSELKVSADNVSLTGAWSLASMLTEIFLLQQAQGMPEPGWGRITDSHQWNTLLSLHNAQFDLLQRTPEVARSRATPLLDLIKTALTPHPPQKQAYGVTLPTSVLFIAGHDTNLANLGGALELQWTLPGQPDNTPPGGELVFERWRRLSDNSQWIQVSLVFQTLQQMRDKTPLFLNTPPGEVKLTLAGCEERNAQGMCSLAGFTQIVNEARIPACSL

SEQ ID NO: 19 - DNA, 1236 bp, Artificial Sequence
  Synthetic construct, Phy-03 coding seq
gcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgtga

SEQ ID NO: 20 - protein, 411 aa, Artificial Sequence
  Synthetic construct, Phy-03 polypetide
AQSEPELKLESVVIVSRHGVRAPTKATQLMQDVTPDAFYTWPVKLGELTPRGGELIAYLGHYWRQRLVADGLLPKKGCPQSGQVAIIADVDERTRKTGEAFAAGLAPDCAITVHTQADTSSPDPLFNPLKTGVCQLDNAQVTDAILERAGGSIADFTGHYQTAFRELERVLNFPQSNLCLKREKQDESCSLTQALPSELKVSADNVSLTGAVSLASMLTEIFLLQQAQGMPEPGWGRITDSHQWNTLLSLHNAQFDLLQRTPEVARSRATPLLDLIKTALTPHPPQKQAYGVTLPTSVLFIAGHDTNLANLGGALELQWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 21 - DNA, 1239 bp, Artificial Sequence
  Synthetic construct, PhyNov9x coding seq
gctgcgcagtccgagccggagctgaagctggagtccgtggtgatcgtgtcgcgccacggggtgcgcgccccgaccaaggccacgcagctcatgcaggacgtgaccccggacgcctggccgacctggccggtgaagctcggcgagctgaccccgcgcggcggcgagctgatcgcctacctcggccactactggcgccagcgcctcgtggccgacggcctcctcccgaagtgcggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacaacgccaacgtgaccgacgccatcctggagcgcgccggcggctccatcgccgacttcaccggccactaccagaccgccttccgcgagctggagcgcgtgctcaacttcccgcagtcgaacctctgcctcaagcgcgagaagcaggacgagtcctgctccctcacccaggccctcccgtccgagctgaaggtgtccgccgactgcgtgtccctcaccggcgccgtgtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgaactggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctctccctcaacaccccgccgggcgaggtgaagctcaccctggccggctgcgaggagcgcaacgcgcagggcatgtgctccctcgccggcttcacccagatcgtgaacgaggcccgcatcccggcctgctccctctaa

SEQ ID NO: 22 - protein, 412 aa, Artificial Sequence
  Synthetic construct, PhyNov9X polypeptide
AAQSEPELKLESVVIVSRHGVRAPTKATQLMQDVTPDAWPTWPVKLGELTPRGGELIAYLGHYWRQRLVADGLLPKCGCPQSGQVAIIADVDERTRKTGEAFAAGLAPDCAITVHTQADTSSPDPLFNPLKTGVCQLDNANVTDAILERAGGSIADFTGHYQTAFRELERVLNFPQSNLCLKREKQDESCSLTQALPSELKVSADCVSLTGAVSLASMLTEIFLLQQAQGMPEPGWGRITDSHQWNTLLSLHNAQFDLLQRTPEVARSRATPLLDLIKTALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 23 - DNA, 1233 bp, Artificial Sequence
  Synthetic construct, PhyQB coding seq
cagtcggagcctgagctgaagctggagtcggtcgtcatcgtttcccggcacggcgttagggccccaaccaagttcacacagctgatgcaggacgtgacccccgatgcttggccaacctggcctgtcaagctcggcgagctgacccccaggggcggggagctcatcgcgtacctggggcactactggcgccagcggctggtcgctgacggcctcctgccaaaggttggctgccctcagtctgggcaggtggctatcattgccgacgtcgatgagcgcaccaggaagacgggcgaggccttcgccgcggggctcgccccagactgcgctatcaccgtgcaccatcaggcggacacgtccagcccagatcctctcttcaacccgctgaagaccggcgtctgccagctggacgtggcgaatgtccgcagggctatcctggagagggccggcgggtccattgccgatttcacaaggcattaccagactgcgttcagggagctggagcgggtgctgaacttcccgcagagcaatctctgcctgaagcgcgagaagcaggacgagtcgtgctctctcacgcaggccctgccctctgagctcaaggtctcagcggacgatgtttccctgacaggcgcctggtcactggcgtccatgctcactgagattttcctcctgcagcaggctcaggggatgccggagccaggctgggggcggattacagacagccaccagtggaacactctcctgtcgctccataatgcggttttcgatctcctgcagaggacccccgaggtggctcggtcgcgcgccacgcccctcctggacctgatcaagacagctctcactccacacccgccccagaagcaggcctacggcgttaccctgcctacgtccgtgctcttcattgccggccatgataccaacctcgctaatctgggcggggccctggagctgaactggaccctgccgggccagcccgacaattacccacctggcggggagctggtgttcgagaggtggaggcgcctcagcgataactcgcagtggattcaggtgtccctcgtgttccagacactccagcagatgcgggacaagacaccgctctcactgaacactccgcccggcgaggtcaagctcacgctggccgggtgcgaggagaggaacgctcagggcatgtgctccctggctgggttcacacagattgtcaacgaggcccgcatccccgcttgctctctctaa

SEQ ID NO: 24 - protein, 410 aa, Artificial Sequence
  Synthetic construct, PhyQB polypeptide
QSEPELKLESVVIVSRHGVRAPTKFTQLMQDVTPDAWPTWPVKLGELTPRGGELIAYLGHYWRQRLVADGLLPKVGCPQSGQVAIIADVDERTRKTGEAFAAGLAPDCAITVHHQADTSSPDPLFNPLKTGVCQLDVANVRRAILERAGGSIADFTRHYQTAFRELERVLNFPQSNLCLKREKQDESCSLTQALPSELKVSADDVSLTGAWSLASMLTEIFLLQQAQGMPEPGWGRITDSHQWNTLLSLHNAVFDLLQRTPEVARSRATPLLDLIKTALTPHPPQKQAYGVTLPTSVLFIAGHDTNLANLGGALELNWTLPGQPDNYPPGGELVFERWRRLSDNSQWIQVSLVFQTLQQMRDKTPLSLNTPPGEVKLTLAGCEERNAQGMCSLAGFTQIVNEARIPACSL

SEQ ID NO: 25 - DNA, 1086 bp, Artificial Sequence
  Synthetic construct, ZmPhy1 coding seq
gccgggatgactgatctgctgatgctgaccgacaagtcgcagctgcaggcgctagcgatgctgctgcggaacaacgaggagctcatgatgagccaagcgatcaagtcggagacggagcgcgttgagtacctcaagacggtgagcgactgctacacgcggacaatgaagctccttgacgactccatggcggccaggatcacgtacgagcgttcgggcggaacgaggagcctcgtcgcgcgggacatggacgactacgtcgtctacggcctcaacgcgtgcttgcagaacgtccgcaactgctgcgtgcgtctggacgccatcgacaagctgcgggcgcactacgacgccctcgccgacgccgtcgccgaaccggccgccaacgtcgagggcctcgccgcggaggcgtccgagtacaaggccgccatgtggcagtactgctacaaccagcggagcgcctccgcgcgggcgcactcccgcgcctactcccaggcgctcaagctggagggcatcgacttcgccgagcttgtgcggaggcaccagctccggctcgggtacggcagcaagggcgaggagttcgaggacctggacgacacccagaagctggaggtgtacaacagcatcatcgtcgagtcggggcgggcggggctaccggtgcggatgttctcgtcgggccgctctgccggtggccctaagattgcagccacgacgtgggcgcaggcggtgagcgtcttcatcatggcggcgggcaacctggcgtgggacgtgttcaccacggagcacgaggtggaggccatcctcaagggcagcctcaacctcctggcggggctagggggcttcgccgtggaggccgtcgtcggcgcggctgtcaccaaggcggtcgcaaacgtcggcgccggcgtctttgcttgctctctcgcgggcttcgtcgtgggcgccatagccgggctgatcttcatcggcgtcagcggcctcctcattaacctcatcatcggctccccgaggaaggtgcctgacatgagcaagctcatgttccacaccgccgtcatgcccgatggaatggcccttgcgtatgcggtatctcattaa

SEQ ID NO: 26 - protein, 361 aa, Artificial Sequence
  Synthetic construct, ZmPhy1 coding seq
AGMTDLLMLTDKSQLQALAMLLRNNEELMMSQAIKSETERVEYLKTVSDCYTRTMKLLDDSMAARITYERSGGTRSLVARDMDDYVVYGLNACLQNVRNCCVRLDAIDKLRAHYDALADAVAEPAANVEGLAAEASEYKAAMWQYCYNQRSASARAHSRAYSQALKLEGIDFAELVRRHQLRLGYGSKGEEFEDLDDTQKLEVYNSIIVESGRAGLPVRMFSSGRSAGGPKIAATTWAQAVSVFIMAAGNLAWDVFTTEHEVEAILKGSLNLLAGLGGFAVEAVVGAAVTKAVANVGAGVFACSLAGFVVGAIAGLIFIGVSGLLINLIIGSPRKVPDMSKLMFHTAVMPDGMALAYAVSH

SEQ ID NO: 27 - DNA, 1089 bp, Artificial Sequence
  Synthetic construct, ZmPhy2 coding seq
gccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacgtacgagcgttcgggcggaacgaggagcctcgtcgcgcgggacatggacgactacgtcgtctacggcctcaacgcgtgcttgcagaacgtccgcaactgctgcgtgcgcctggacgccatcgacaagctgcgggcgcactacgacgccctcgccgacgccgtcgccgacccggccgccaacgtcgagggcctcgccgcggaggcgtccgagtacaaggccgccatgtggcagtactgctacaaccagcggagcgcctccgcgcgggcgcactcccgcgcctactcccaggcgctcaagctggagggcatcgacttcgccgagctggtgcggaggcaccagctccggctcgggtacggcagcaagggcgaggagttcgaggacctggacgacacccagaagctggaggtgtacaaacagcatcatcgtcgagtcggggcggggcgggggctaccggtgcggatgttctcgtcgggccgctctgccggtggccctaagattgcagccacgacgtgggcggaggcggtgagcgtcttcatcatggcggcgggcaacctggcgtgggacgtgttcaccacggagcacgaggtggaggccatcctcaagggcagcctcaacctcctggcggggctagggggcttcgccgtggaggccgtcgtcggcgcggctgtcaccaaggcggtcgcaaacgtcggcgccggcgtctttgcttgctctctcgccggcttcgtcgtgggcgccatcgccgggctgatcttcgtcggcgtcagcggcctcctcattaacctcatcatcggctccccaaggaaggtgcctgacatgagcaagctcatgttccacaccgccgtcatgcccgatggaatggcccttgcgtatgcggtatctcattaa

SEQ ID NO: 28 - protein, 362 aa, Artificial Sequence
  Synthetic construct, ZmPhy2 polypeptide
AGMTDLLMLTDKSQLQALAMLLRNNEELMMSQAIKSETERIEYLKTVSDCYTRTMKLLDDSMAARTTYERSGGTRSLVARDMDDYVVYGLNACLQNVRNCCVRLDAIDKLRAHYDALADAVADPAANVEGLAAEASEYKAAMWQYCYNQRSASARAHSRAYSQALKLEGIDFAELVRRHQLRLGYGSKGEEFEDLDDTQKLEVYKQHHRRVGAGRGLPVRMFSSGRSAGGPKIAATTWAEAVSVFIMAAGNLAWDVFTTEHEVEAILKGSLNLLAGLGGFAVEAVVGAAVTKAVANVGAGVFACSLAGFVVGAIAGLIFVGVSGLLINLIIGSPRKVPDMSKLMFHTAVMPDGMALAYAVSH

SEQ ID NO: 29 - DNA, 24 bp, Hordeum vulgare
  misc_feature (1)..(25): HvVSD coding seq
gacgagctgaaggccgaggccaag

SEQ ID NO: 30 - protein, 8 aa, Hordeum vulgare
  MISC_FEATURE (1)..(8): HvVSD polypetide
DELKAEAK

SEQ ID NO: 31 - DNA, 18 bp, Artificial Sequence
  Synthetic construct, SEKDEL coding seq
agcgagaaggacgagctg

SEQ ID NO: 32 - protein, 6 aa, Artificial Sequence
  Synthetic construct, SEKDEL peptide
SEKDEL

SEQ ID NO: 33 - DNA, 276 bp, Agrobacterium tumefaciens
  terminator (1)..(276): NOS terminator
tccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 34 - DNA, 180 bp, Cauliflower mosaic virus
  terminator (1)..(180): CaMV 35S terminator
ctgcacaaagtggagtagtcagtcatcgatcaggaaccagacaccagacttttattcatacagtgaagtgaagtgaagtgcagtgcagtgagttgctggtttttgtacaacttagtatgtatttgtatttgtaaaatacttctatcaataaaatttctaattcctaaaaccaaaatccag

SEQ ID NO: 35 - DNA, 1006 bp, Zea mays
  terminator (1)..(1006): Maize globulin 1
ggccgccgcgctcgccaaaacgagcaagaagcaacaagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcggatacgatgctgtatgctactgaggcaagtcccataaataaataatgacacgtgcgtgttctataatctcttcgcttcttcagtgtccccttgcggagtttggcatccattgatgccgttacactgagaacataacggacacagtagacgaaccacttgagttcttgtatgaaattctgacccttttttttgaaggatcaggagggggaaacccctactggcctggtccttttacaatcaataaaaagaaaagaaaaagaaagaaaaaggaagagctatttctatatttgccacaaatttagccagttcgggattgaggtgtcgaattctccccgtgctctgtgaatgattagtcgcaattctctactaaattcctgagtacagcggagcacggagggatctctgtttgaaaacaaccactcgtttcggcttttccagatgctccaagtcataagaatagtgatctccatagagaagggaacgttgagctggtgtttgaggttcacagatgcctcttcagggttggaaattctgggtggggtaatgccaattgagttccagcaggctttcgcgaagttgcatctgaggaaaagatgataaagggtctcctctctttgccaaaggcagttttcgcaagagtaggaatctagctccatgtttctccttctcaacatatttctggtgtttagcctgttcttaagccacagccaatagaagactctatgcttaggctgacacttacttttccaaactagtttgtagataggatgagtttgcatctggcccatgaaagatctgtaagctttttgggacgacccggggaat

SEQ ID NO: 36 - DNA, 3676 bp, Artificial Sequence
  Synthetic construct, prGTL:ZmGammaZein27:Phy-02:SEKDEL:NOS
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 37 - DNA, 15787 bp, Artificial Sequence
  Synthetic construct, pAG4281 vector
caaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtac

SEQ ID NO: 38 - DNA, 11 bp, Artificial Sequence
  Synthetic construct, partial  promoter sequence
gtgtgaggcgc

SEQ ID NO: 39 - DNA, 480 bp, Zea mays
  misc_feature (1)..(480): Chromosome 8 excerpt
agtggacctcgaagtctatctttcgagcagaaatttttgaatgcgtattagtggcagatggatgaatgtctggcctttcccaaacgttaacaagcatatgcattttcaaatattactttcaaatgtttcagcttggcaatcacttgcaaaactctccaacttaaaaagacttgcttttgaatttcttattataaacccagacaacccaagctcatatatcttagagcctttattcttttgtgaccgaactcatcaatattattcatcaccaatcaccattggttatataaatcaagatagatacgtagctaatcgtcttccatgcatattgtccgagatcgcatcgcatctcgcatcaaacgctcagcatccatgttctttcttgacgcaggtgctgttgcagttgctttggcaagtgggggaagcatgactggaacataccctgcttgcttgcttggcaatctgtatagtccgtcatgg

SEQ ID NO: 40 - DNA, 609 bp, Zea mays
  misc_feature (1)..(609): Chromosome 2 excerpt
cgaaggtgctctagggaagagattacaagaggcaattatctagcccaccaagaggtactttatgcaggacattgtttatctatttataggggaacatatagcttcgtgcaaaattacaaatatatctgtaaaaccagtacgtatgatttacaaatgatgtgagggcaatattgttttgtgcctttagcattatggatgacgccttctccctggtacgttgatattctgcctttgtctccttgtgttgttatgacgaagttaacatcttcgtctttctccgtgccttgcttcaaaggtatttcgtcgccgaagctcctgcgacacttaataacactgcgacacttaataacacgttggcaaccaacagctagatgtgttttttaggaccttcaaaagatgaaggcccctaacatcgccttcgccaaatctggaccggcagcaccttggccacacacccttctcggacgaaaccaaacctcttagaaatccagagctcatgggggatgtcaaggtggtggttgacctaaatgaccaccctgattaggccaaatctgggccgctatttccctgacctcacaaccagccgcaaaggcgcggtggacatcctcc

SEQ ID NO: 41 - DNA, 6435 bp, Zea mays
  misc_feature (1)..(6435): Chromosome 5 excerpt (B line)
aagcttcaacgttaatccagccatctttgtcacaatggtttaatgggcaacgaccgttgtgtaatacaactagtttgggagtccaaataccggagagaattagaggtgctaaaatctttttcttattcaaaattcaataaggagaggaatttagcccctccgattttatggcttctaaactagccttaaatgtaaccgtacaagtgagccttcgaatccgttagatataatcaatcatatattaaatttaacacttaaatcctgctacaccggcttacgtagatttgtataaaaaacctaataagccacagttatatccaaactagttttgttggcttccggcggtatgtctcttttctttaccggcggtttataaaaagcggaagccactagtatgagatatgtagatatggactaaaaagatattaatgtaaggagatgtttggtttataagaactaatttttagtccatctattttattttattttagtttctaaattaacaaatacgaaaactaaaattttatttcctatttagcaatttaacgactaaaatgaaataaaataaaaaggactaattactaaatgtgggaactaaaattctattttaatttccatatttactaatttagatattaaaatgaaataaaatggagggaataaaaattagtccctagaaactaaacacccctaaaaattagtctctacaaatcaaacatcccctaaaaattaatcagtagaaaacaaacatctctaaaaattagtagttaaacttatgtaaaaaaaattagtcaaacttatgtaaaaaaccaaataaattaaaaattagaacaaagagagtagttaataaaccacatataacaatagaattgttataaatgctgcttctatttcctccgatcggaactgttcagccaccttccatcgatagcgaacttggatcagccaccttccatcgatagcgaacttggaggttcaaatattgtaaaaatacaagaagaaaggttttactctttatttctttgaaaggggtcgccgaagaaggttagttgatgtctcttatagcttttttgcacaggtgtaagagcaatcaaaccctatatatccgtttcaaatcaatccgaagcgtagagaagtctactgtttttttagcgtggtaaattgtagacccctctcgtggacatggtgacttcttttaacattttaagtatttttaagataatggacacatggataacatatatatactactctttaaattataacggacatgcactaactaaccttcttcggcgacccctttcaaagaaataaagagtatttataaagttgtgataattggatgttgattataaatctaatagtatcaattttatatttaaaatgtgaaaatcgaaaaggaataaattacaatggaccctggctattgtaagtttggaactctgtttccctacaaatcacactcgtgtcaagagcttctagcagcccagaaaaggtggactttgctctagtgtcagaaaagtccgagtgagctatatttcttggaaaatacaagtttgtttcagagcaaaaaacatttttcttttataaaagggccagcatgacaagatgatggctgactatcagcaaaagacacgaagtacaaaaaagaacaaaagatgtaaaaccctgcatccactgtattcatggacaacaaaaacagttcatcgatcattgttcaggtagaacacagtcgaaagaacgcaccccagagccagaatgcgaggaagcctattttcataataaaactgagagcgagaacacatttttttataagcgagcgacaacgttgaaccaagggcaagccatgcgcgtgtactccagcggtcgtcctcaccaacccaagtctcgagtcctgaatcctgatgcgcaccaaccacagccctaccaccgagcttcctgccccctccggccaacacgaaacttccgaaccactgtccactggctcccaagattagcgtatgtctgtgttctctgcaaacaaaaactcgtacattgccttggtcgtcttggaccagtcaccacagtccacaccaccagctcccctccctttccggaccctattgtgtttggaaaaatttcactctaaagctattcttatcacactatttttaatgttatcacgtcaataagattaaaatgcatttaagaacgaaatatgctctctcaatgaagagtttcatgacacaattttataggctaacatgtgattttaaatgttgcatgtaaataaccaatatgaatagataaaatagatggagataaataaattgttctcattggtggtttcatgcgcttttcagtaccttgaaaacgggttgacatagtttcgtagtgatgaaactagtttaatctatttcataataaatgtagtgttgtgtcatcaaaaatattatgtaattaatgtcataaataaattctctcataaaactctcatcgagaatggtctaagaaattcagctctattccacgaactctaccttttaataggtccaccatagagttgaaacaggaaaaattgtttagcttagcatttgactctagctccatgaatgatatagattttagaggaaatatctcttatattcttattttcaaggacccacatataggtgacctaattccattgtttctctatctttcatcgcactcacccagtcatctctctcgataaaacgatgcgaggcatgagatggcggcctccatcctcgcctccacgaggagatgcacatggcgagcccactggttgcccgtgagaagtggtcgtagcaagccgactgccgatgtggaggaggtggcacgctagggatatatgtccgccggtgtggaagaggaggtgcgctggggaagcgtgtcgacttggaggaggatgcacaatggggaaagtcgccccgccgatagcgaggttctaggcggtgacgtggaagaggtggcgagatcctaggcgatgggggcgaaaactgcaaggtcctaggccatggtagcggtgggaggcgaggtgaagcgcaatggacatagcattctttttgtgattcggtatgggagggagtgtgtaaatagtagcaatacgggtaattaccctacaactccaagaggaggtacaaaataatgattcctggggcaccccttggagctccacaaaaaactgaagttgaggctaggtcctcatttttttatggcgccagagttgaaggtggtttcgttgatgcgatatattaaaaaattacattaccgcctaacatatgaaggattgactatacaacgtcctcaactataaacttaatattatagctacatctaaaattatttaaatggctctctagatggtcttgtaggaccgtttggacaccatatccaattacattgactcatgcatttatacttgcacacatgcacatcggttgtctccatcttcctactatttaaaggtctaccgaacaaatatccgtcaagcaacccaggaggcgatgttgtcgagcaacctactcatcgagcaacccaataaggcgaggctgccgagcgatctgcctgccaagtaacccaccaaggcggggttgccgaacaacctgcccgccgagcaacccagccaaccaaccggtcctccgagcaacctagcaaaacgacagtcgactcataggaagagtcggcctggtacaatcaagccacgacaacatgacgagacatcatcgagccagatccagaccgtgaaaacggcactgagggatctttgtcaaacatgacgacggatacgtatccctgctgacacatgtgaccggacgaccccgaccgtagaaacctcagcatcggggtttctacagtgacccatacaccggaagggatgagacaatatgtcgtatcaagcgtgcatctacgtatgatgaaagatgacgctgctcggaggatgacagaagatgaagttgtatgaacacatccctaaagcactcattgagctgactcaacagaaactaccaggcactgccacgtctaaatcagagtagctataggaaggcggacaggacgtgacgccataccaggggtacggcgcacgcctcgactaacgactctacaagggctacgaggcccaaaagcgtgacccaacagacgagaccaccggggctacgaggcctagaagcaggataccaaactctaccctagtagaatactagtcctcattgtaacgtctatccttggactataaaagggcaatacaaccctcatccaaacatgatcccgtatctctacaacttcacacaagcactcagctgtaacacgttccatcattgtattgtctacccttgggctataaaagggcaagacaacccccatccaaacatgatcctgtatactcagctgtaacacgttccaagcaatatcacaatcagcactgcactggactagggctccggtctgaactagtataaccagcccgcctcagatccacacccatagctcaccattcgaagtgagtccgtgctaacactcccgccgaatacaaatcttattgtccactggttccagaaaccacgacacttatcttaaaaacttatgtttcaacttaatacatattgaagatagtaaaggtgcaatgcaaatgatagcaacaaatatagaatgattggtaaaattatttattagaactaaatagaacatgtatggtatgtacatgggtagagttatgaaataaagagaataaatataattaattttgagtagttatgcatattttaaaaaaccatatagatttatgtgacgcaagattccagacagtgttgaaatgcctttatttgacaatgtttatagagtgataaacatggcaaatagaccatgagatggttatatgagcaagatagtgcttcccgcgcatgtgttcgttactctcccatgtgttccggtccttcgacagcaaacacttaaagcatggacttaacaaagtgcagtaatgcggtctcattatagcacaccccccacataaaaaaacaatatccgcagctagaagacaacacacagcctaagcacgttcagccgaggccaagcaatccgcatccgccccagcccccagcagccctcaccaaccatcattgtgtgtagttgttgggagaggggagggccttgacgaatgacgaggaccaaccacagccccgccgctacagagctacccgccccaacggcgaccaggaagtttccacgccgctggccttgtgacatgcgcacattgtcttggtcgtctttggacaagtctcgactctccacaccaccagcccggtcccttctcagaagcattagctatttaaacctcgccactcctgctggttctctccaggaagagcagcactagatctctctcccctacagcttcccagcaagccagttgcatacatttcactgctgttatctttctcagcttgatcagtgctttagttctctctagttgcaatggcttgcgatttcccgtgcatggcgacgccccgcgccgacccgcttaactgggggaaggcggcggaggagctgatgggcagccacctggacgaggtcaagcggatggtggccgagtaccgccaaccctcggtgaagatcgagggcgccagcctcagcatcgcgcaggtggccgctgtggccaccggcgctggcgaggctcgggtcgagctggacgagtccgcccgtagccgggtcaaggcaagcagcgactgggtcatgagcagcatgatgaacggcaccgacagctacggcgtcaccaccggcttcggcgccacgttgcacaggaggaccaaggagggcggcgctctccagagggagctcatcaggttcctcaacgctggcgccttcggcaccggcacggacggccacgtcctcccggccgaggcgacgcgcgcggccatgctcgtccgcatcaacaccctcctccaggggtactccgggatccgcttcgagatcctcgaggcgatcgtcaagctgctcaacgccaacgtcacgccgtgcctgccgctccgcggcacggtcaccgcgtccggcgacctcgtgccgctctcctacattgccggcctcgtcaccgggcgtgagaactctgttgccctcgccccagacggcagcaaggtgaacgccgccgaggcattcaagattgccggaatccagggcggcttcttcgagctgcagcccaaggagggtcttgcgatggtgaacggcacggccgtgggctctggcctcgcctccactgtgctcttcgaggctaacatccttgccatcctcgccgaggtcctgtccgccgtgttctgcgaagtcatgaacggcaagccggagtacaccgaccacctgacccacaagctcaagcaccacccgggacagatcgaggctgctgccatcatggagcacatcttggagggcagctcctacatgaagctt

SEQ ID NO: 42 - DNA, 18621 bp, Artificial Sequence
  Synthetic construct, locus 3293
tgggtcgactgattcactgttttccctttttccatttttataattttaatttaagtttgatttccatgttcaaataaattgtgatccaaatcacttcaaaaaatcataaataattagaagagcactttagtaaagtttgatctcatttcttggtgaggatttttatacaaaaataatgttttccctttctgtatttgaggaaaacatatgtaaactcatgtttaaagggaaaagaaatcaaattcctctctaaaacttgtgacatgtgtttgtgtattcatagtggttttgtgtcatacaaaggtagagtgttacaagcttacatgtatgttctacttatggaccctacctatcatcaggcctactgcttctatctcattgtgatctcatatctaaacaaacacaaactctatacctcatagccatgcaatgcacatggagcgcgcatcagtgttaatcatttctattgaggtgaccttccaagctaggcctcgctgagtgaggacatgtgccttaaggggactagtacaccataatagaatctcagtatggttccttgtacttttactacatgtaagtatattcatactacctagtcatcgctatagtattttttccattccttggtaaagggcatgattgcctgacctggtatggcattaaatgtgatggtagacctacacaatggcaacgagtacatctgtagccctaagagcatgtcaggttgaaggtataaccataactcatataataatgtagtttgaagcattacttatctccccatttgtagttgttcctgtctagattttatgttacgtttgaggactttctcgaggtgattttcataccagttggtgggacatgtatgataagttgtgtctatgggtgcccaggcctgtgtcgcttggtatgatgtaattggtacctaatgtagccttttgtacttgattgtgttttatggtacactttgtgtgtgcacgctcaactatagggttagtgcacacaccatattgtggtcatgagtaccctatagcctagtcgtggcaacaacatgtgtgtcagggcttgcaatatcgcccatcacacatttcatgctttgtacctaagacttatctactagactatcgctaagaaatagtctataaacccttagatgtgggatcgatttcctagggatataacatccatggtggcccctaatcacatccctctatctttgcaaaaaagattacacttcgagcccatgccccaaagtgcccacatctcgattgcccacaaagtacgagatcagagactcttcagggaacctagcatcaacggatcctaagcagctaagtggtgtagtgtatagggtttagactgtcctaagcatccacagtcttcttatcatcatagaacatgaggggctccgagaacccatatttactagcgtttagggacaatgaggggctccaaggacttaggcttataagtgtctcaggacaggtgaggcctgaggacttataagagaccccctgatgagtgatgccatgcgggtatagtctcatggatgttctaggacatgggggttgtggacttattctttggtcaatgcattgtggcacaaggtgccttagagacttagaccattttacctttgaaggtcttggggagctatggatcccgagcctcatggcgtgttggtgactcaaaaagccaccaaccttctggcatttgagaattcatctcatccaaaaacttctataatatatcattcagtgtcaggcctctcccttggctagggctaggagaggttctagtaacttggggaagcactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcctaagcggccgcattggacttaattaagtgaggccggccaagcgtcgatttaaatgtaccacatggcgcgccaactatcatgcgatcgcttcatgtctaactcgagttactggtacgtaccaaatccatggaatcaaggtacctccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacccggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctagtggacctcgaagtctatctttcgagcagaaatttttgaatgcgtattagtggcagatggatgaatgtctggcctttcccaaacgttaacaagcatatgcattttcaaatattactttcaaatgtttcagcttggcaatcacttgcaaaactctccaacttaaaaagacttgcttttgaatttcttattataaacccagacaacccaagctcatatatcttagagcctttattcttttgtgaccgaactcatcaatattattcatcaccaatcaccattggttatataaatcaagatagatacgtagctaatcgtcttccatgcatattgtccgagatcgcatcgcatctcgcatcaaacgctcagcatccatgttctttcttgacgcaggtgctgttgcagttgctttggcaggtggggaagcatgactggaacataccttgcttgcatgcttggcaatctgtatagtcgtcatggatagaaaggcaggcgttctgggcttccaagttgcagtcccggctgcaggtgccgtagctgcagtaggccgcctggcacccctggaggacctgcctttcgcagtcctcccgggcagccgtggtgtcgttgtcgcagtagcctctgcaggttgtggagttggcagcctctgcagtgcagttcgtattgcacagcgacccacactcgctgcataatggccctttgtttggatgccccatggaagatacgaccagaatggcgagaacggcggcggtggcgccggcgccggcggcatcagaagccattgctgcagagatggacacggcaaggcaatacctagatatagagaggagataggatgtcaatgtcaacgagattaattggtgctcagatgattgagcggctgatgctatttataggctccaaactaattaagggaacatctagcctaaattattatatagacggggtatctaatgtataattaagggttttagtgttgtatatacaagttgacttgaagtcgtcgaagaggagaatatcatattcacctttcactgggttccattttgatttacaatccgaggtgaagctaaaagttgactggtcacacttaactcagacaggtccaaatgtgaaacaattgtaggatcaaaaaatgcacattcattaattctcattgcagagaacgtaaccacgcgtgcgtcattttttatttattatgtgctaagaatatatttgagaaagatgcaaagggtttcgtttattagataaaacaacatgtaaattttggtattaagcttttaggttgaaccggctgatgcgagaggaaattaagtggtgaaactgaggagctcacaatgttactgacaatcaagtgtctagctaatggagcattaatttttaacaaagtcagaggcagtagagataactcttacaagtagatcgaagattcacgtggagtaacatgcagtgagtacgacactcagtttacttttgatggacaacttgcttttagtcaactgcgtgcatgtccaatcctgtggcgttttccccatcttggttgatacttgctaactatgtacggcacaaagttgacgagcaagagatggcactcggcatggtcgccgcttccgtgcttgctatcttcgagcgagctcgcgcgttgttctcatgtggagcagatt

SEQ ID NO: 43 - DNA, 13109 bp, Artificial Sequence
  Synthetic construct, locus 3507
aagctgccagaagactgagctgataggcgagagctcctacgggtaggtagaacatgtttctctttgcacatgtgcttttttggggtgtttggtttgcccctgctaaaatttagcccctatcacatcgaatgtttgaacctccgttcgaggtattaaatgtagtcggattataaaactaatttctcagccgaacattaaaaagtgagacgaatctagtacagttggttgggtctatatttcatactcctatttaaaagtcaaacgcttgatgtgacccgggctaaattttagtccacagaaccaaacacccccttggctcggggtggcgcagacagagggtatgcaatagcgggggagcagtggcgaagcatcgcgacgagggtggggttcttgctgtcagacaataagtcaagagtggtgggtgtagcggcacggcggggcgagcaatagtgcgccagagatggtgagcgaggtacatgtggtgggcttctagggtcaactgcaggggaggtggttaggattttgtaggcatggcatggtgagcaaggagggcaaacatcacggataagacaaaaagttcgatgagggtgcttgtgtgggaccggtttgtgggggttcgctgtccacagaattggcggcagctagagatgtccaaacgggccgcccggcccggtccggcccgggcccggtgaagcccggtccgttttgggcccggcccgccaggcacgattaaaaaaccgggccgggccggctaagcacgcgggcttaattccttgtccgagcccggcccgcaatgggcctaaacgggccgggccggcccgtttagcacgaaaaaagcgggccgaaaagcgggctatgcgggccgaaaagcacgttttagtgtaaaaaaagcgggcttaacgggcttagagctaaacgggtcgtgccgggctagcccaccgtgcctaatttcctgtccaagcccggcccgcttattcgtgccgggccggcccgggcccgcatataaccgggccgtgccgggctcggaccgggcccaaaaaacgggcttcgtgccgggctcgcgggcctcgtgcttattggacatctatagcggcagcaggggccgggggacatttggtgggttgtcacgaggttgggccctggcctggggattgacggaagatgggcctaaagtagccatgcatgtgtagctactctcgcctgttgatcacttgttctcaattgctatacacaattgaaaataaggcaacacagtgttaaaaagataattaaccttcgtcctccaacaattatcctttcggaataacttttcgaggatgaaggttaggattttaatcgaatgaatcatacatcagtatataaatgagtatacatgaaatgtaaagaacttaaacatgttaactcatctcagatatctcaatatctcatttatctcctttcatataataaatttacaatcgtaccttcggttctacaaagtgagttagagcgaaggtgctctagggaagagattacaagaggcaattatctagcccaccaagaggtactttatgcaggacattgtttatctatttataggggaacatatagcttcgtgcaaaattacaaatatatctgtaaaaccagtacgtatgatttacaaatgatgtgagggcaatattgttttgtgcctttagcattatggatgacgccttctccctggtacgttgatattctgcctttgtctccttgtgttgttatgacgaagttaacatcttcgtctttctccgtgccttgcttcaaaggtatttcgtcgccgaagctcctgcgacacttaataacactgcgacacttaataacacgttggcaaccaacagctagatgtgttttttaggaccttcaaaagatgaaggcccctaacatcgccttcgccaaatctggaccggcagcaccttggccacacacccttctcggacgaaaccaaacctcttagaaatccagagctcatgggggatgtcaaggtggtggttgacctaaatgaccaccctgattaggccaaatctgggccgctatttccctgacctcacaaccagccgcaaaggcgcggtggacatcctcctcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcctaagcggccgcattggacttaattaagtgaggccggccaagcgtcgatttaaatgtaccacatggcgcgccaactatcatgcgatcgcttcatgtctaactcgagttactggtacgtaccaaatccatggaatcaaggtacctccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacccggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctactaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgcgagccactaggcgtgtgaaaaaaacgtttcgaggttttttcaagacgctcgaaagaaaaggacgtaccttcgaaggccaggggaatgaagtgatgaacgtaggaggtgaatcgaaggagtgccacgccatatcagagggcagcaggtccatcgggatctcgggagcaatggtttggaggcaggcgcgtaactggtctatggactctagcataaccacatcaccctcggatgtgtaggcatgcaggagccagcacttgagagcgtggttgctgggaggcaactaagcttctagatactatgtgtgactcccagcattttctttattgcccgagctttcctccgaagctgaggactcctccccaccctgagagtggccggcgtccgacaccgaggaggcgaagcaggatgtagtagcactgacacggttatggcttggaaagataggggcgaccggtgtccactagagggggaggggtagcgacatgaatgcctacctcccactagggaagaagatggacgttaaccgtgcacacatagaaagacgaggcaacaacttcatcggtaggggaggccccatgatcaccacagtgcaagcatccggggtgggtggagatatgcagaggggcgtgcaggggacgagggtggcgtgtgaggccgcgcggcctccccctccgctcgcatgctggctacagacgcgccccttgccgtgcagcgcttccccctggaagcccctctacgcaggggaaaggaacaggagcacgctgcagatagcgtgagcccgtgacgccccctgccactgtttcttcgttgggtgagtttttaatatgtgaaaaaaaaatggtaataaatgatgagtaggtttggatagtgatattttatagttgtagtggggtatagggggagaatatagagggaaccgctgcgggagatgaaaaagtaggggatgaaatgttgatgatgtgacgcaaaaaagtgatatagggggacaaatttaggggtaaccgttgcagatagtctgaggcagcgtcgcagcggttccaagctggaggagaggtcattgatgggaacaaccacaacagagaaggggtggagcggacatggatcaaagggtggcggcggtggaatgaggcgaggacgtggttgatcggcgtggcgtgggatgggctctaatgaccaaagtccctatagtttctacaacaaacggggtcgcaacagtctttgacttggtgatcggaggcgagacaatggaagcagcggtcggggaggtgataggcttgggttttggagagcgaggtggttgatggctggagagaggagtacttcctggaacaagggggctacattgagcatggagagagtgtgagggtttaagacgacgctagggtttcttgggggaagacgagggtaagtgtggacaagacgtccaattgaacacgaagagatagctgagtcaggtttgtgagagagggagtaaatacttttgaccggagtcaatcttagggacgaaggcataggggcgagaagatctttgatagtcaggctcgccgacttgctgcacgccagctgcgtacggggagggcaggtggcgtaagaggccattgaagtcttgcacaggcccgagcagcaaagcaaattttgaattcgaaacattcccgccgtggctgcgtgtggcgcaaaggctatgaggcactatggccatggcagagagctccaagggatatgggcattacgtaacaccatacatgcaccctcctacccacacctatatatccaacatgtgtgttggggggaaagagggaacattacgtaacagcttgatgcgctggtcgatgggacagagaaaggttctcggctgtcgacgaactggtagatgggcaagaccacgatgccacagatgatcctgagcacctgcttggggtctggtagcgacccaccgcctaccacgatgtgcgagatccactccacccaccttgtcacggtcgacaagccaagcacaaatccaataagatttaccacaaaggcgtcgagttgtagcctgattgttttgtgattacatacgctatcctcggggtggaagcaagggtgtaggatgtcattcatgtcgaggtagaggttgacgaactcgaggttggggttgggcttggaggtgtcgatgggaaccgggactccctcgatctcgctgggctcctcctccaccatgtccaccaccaccatcggtgacttctcaactagccaccagtaaaacgctggcgcgcccctatcaccactgactccgccggaatgctaaccctagaagtggtgtttgtgggcgcggatccatgtagaagaggcgcgcaggaagtatagcgggagctcacatggagtgatgggcgagagggctaggaggataaaaacctatatgcagcgtactcgttcgtgcaactggacaggagagaggtaggaccggggttggttaagagggaggttaaaattaataaagaatttgtggtagttggtatagtgtagagatttaaggtgaatatgattgtggaaaattgtgagatagggtagaaaatctcgctgaccagga

SEQ ID NO: 44 - skipped

SEQ ID NO: 45 - DNA, 3492 bp, Artificial Sequence
  Synthetic construct, PY15_RF sequence
ggttctaggcggtgacgtggaagaggtggcgagatcctaggcgatgggggcgaaaactgcaaggtcctaggccatggtagcggtgggaggcgaggtgaagcgcaatggacatagcattctttttgtgattcggtatgggagggagtgtgtaaatagtagcaatacgggtaattaccctacaactccaagaggaggtacaaaataatgattcctggggcaccccttggagctccacaaaaaactgaagttgaggctaggtcctcatttttttatggcgccagagttgaaggtggtttcgttgatgcgatatattaaaaaattacattaccgcctaacatatgaaggattgactatacaacgtcctcaactataaacttaatattatagctacatctaaaattatttaaatggctctctagatggtcttgtaggaccgtttggacaccatatccaattacattgactcatgcatttatacttgcacacatgcacatcggttgtctccatcttcctactatttaaaggtctaccgaacaaatatccgtcaagcaacccaggaggcgatgttgtcgagcaacctactcatcgagcaacccaataaggcgaggctgccgagcgatctgcctgccaagtaacccaccaaggcggggttgccgaacaacctgcccgccgagcaacccagccaaccaaccggtcctccgagcaacctagcaaaacgacagtcgactcataggaagagtcggcctggtacaatcaagccacgacaacatgacgagacatcatcgagccagatccagaccgtgaaaacggcactgagggatctttgtcaaacatgacgacggatacgtatccctgctgacacatgtgaccggacgaccccgaccgtagaaacctcagcatcggggtttctacagtgacccatacaccggaagggatgagacaatatgtcgtatcaagcgtgcatctacgtatgatgaaagatgacgctgctcggaggatgacagaagatgaagttgtatgaacacatccctaaagcactcattgagctgactcaacagaaactaccaggcactgccacgtctaaatcagagtagctataggaaggcggacaggacgtgacgccataccaggggtacggcgcacgcctcgactaacgactctacaagggctacgaggcccaaaagcgtgacccaacagacgagaccaccggggctacgaggcctagaagcaggataccaaactctaccctagtagaatactagtcctcattgtaacgtctatccttggactataaaagggcaatacaaccctcatccaaacatgatcccgtatctctacaacttcacacaagcactcagctgtaacacgttccatcattgtattgtctacccttgggctataaaagggcaagacaacccccatccaaacatgatcctgtatactcagctgtaacacgttccaagcaatatcacaatcagcactgcactggactagggctccggtctgaactagtataaccagcccgcctcagatccacacccatagctcaccattcgaagtgagtccgtgctaacactcccgccgaatacaaatcttattgtccactggttccagaaaccacgacacttatcttaaaaacttatgtttcaacttaatacatattgaagatagtaaaggtgcaatgcaaatgatagcaacaaatatagaatgattggtaaaattatttattagaactaaatagaacatgtatggtatgtacatgggtagagttatgaaataaagagaataaatataattaattttgagtagttatgcatattttaaaaaaccatatagatttatgtgacgcaagattccagacagtgttgaaatgcctttatttgacaatgtttatagagtgataaacatggcaaatagaccatgagatggttatatgagcaagatagtgcttcccgcgcatgtgttcgttactctcccatgtgttccggtccttcgacagcaaacacttaaagcatggacttaacaaagtgcagtaatgcggtctcattatagcacaccccccacataaaaaaacaatatccgcagctagaagacaacacacagcctaagcacgttcagccgaggccaagcaatccgcatccgccccagcccccagcagccctcaccaaccatcattgtgtgtagttgttgggagaggggagggccttgacgaatgacgaggaccaaccacagccccgccgctacagagctacccgccccaacggcgaccaggaagtttccacgccgctggccttgtgacatgcgcacattgtcttggtcgtctttggacaagtctcgactctccacaccaccagcccggtcccttctcagaagcattagctatttaaacctcgccactcctgctggttctctccaggaagagcagcactagatctctctcccctacagcttcccagcaagccagttgcatacatttcactgctgttatctttctcagcttgatcagtgctttagttctctctagttgcaatggcttgcgatttcccgtgcatggcgacgccccgcgccgacccgcttaactgggggaaggcggcggaggagctgatgggcagccacctggacgaggtcaagcggatggtggccgagtaccgccaaccctcggtgaagatcgagggcgccagcctcagcatcgcgcaggtggccgctgtggccaccggcgctggcgaggctcgggtcgagctggacgagtccgcccgtagccgggtcaaggcaagcagcgactgggtcatgagcagcatgatgaacggcaccgacagctacggcgtcaccaccggcttcggcgccacgttgcacaggaggaccaaggagggcggcgctctccagagggagctcatcaggttcctcaacgctggcgccttcggcaccggcacggacggccacgtcctcccggccgaggcgacgcgcgcggccatgctcgtccgcatcaacaccctcctccaggggtactccgggatccgcttcgagatcctcgaggcgatcgtcaagctgctcaacgccaacgtcacgccgtgcctgccgctccgcggcacggtcaccgcgtccggcgacctcgtgccgctctcctacattgccggcctcgtcaccgggcgtgagaactctgttgccctcgccccagacggcagcaaggtgaacgccgccgaggcattcaagattgccggaatccagggcggcttcttcgagctgcagcccaaggagggtcttgcgatggtgaacggcacggccgtgggctctggcctcgcctccactgtgctcttcgaggctaacatccttgccatcctcgccgaggtcctgtccgccgtgttctgcgaagtcatgaacggcaagccggagtacaccgaccacctgacccacaagctcaagcaccacccgggacagatcgaggctgctgccatcatggagcacatcttggagggcagctcctacatgaagctt

SEQ ID NO: 46 - DNA, 4676 bp, Artificial Sequence
  Synthetic construct, pAG4910
ataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatcctaaaccatgagggtgttgctcgttgccctcgctctcctggctctcgctgcgagcgccaccagcaccgcggttcccgccgagccggcgtcgacgctgtccgggccgtcgcggccggtgacggtggcgatcggagacaggggccacgcggtggacctgccggacacggacccgcgggtgcagcgccgcgtcacgggctgggcgcccgagcagatcgccgtcgcgctctccgcctcgcccacctccgcctgggtctcctggatcacaggggactaccagatgggcggcgccgtggagccgctggaccccggcgcggtgggcagcgtcgtgcggtacggcctcgccgccgacgccctcgaccacgaggccaccggggagtcgctcgtgtacagccagctgtacccgttcgagggcctccagaactacacctccggcatcatccaccacgtccgcctccagggcctggagcctgggaccaggtacttgtaccggtgcggcgacccggccatcccggacgccatgagcgacgtgcacgcgttccgcacgatgccggccgtcgggccggggagctacccagggcggatcgccgtggtcggggacctcgggctcacctacaacaccacctcgacggtggaccacttggtgcgcaaccgccccgacctggtgctcctcctcggcgacgtctgctacgccaacctgtacctgaccaacggcaccggggcggactgctactcctgcgccttcgccaagtccacgcccatccacgagacgtaccagccgcgctgggattactggggaaggtacatggagcccgtgacgtcgagcatcccgatgatggtggtggagggcaaccatgagatcgagcagcagatccacaacaggacgttcgcggcctacagctcgcggttcgcgttcccgtcggaggagagcgggtcctcctcgccgttctactactcgttcgacgccggcggcatccacttcgtcatgcttgcgtcctacgccgactacagcagatcaggtgcgcagtacaagtggctggaggcggacctggagaaggtggacaggtcggtgacgccatggctgatcgcgggctggcacgcgccctggtacaccacctacaaggctcactacagggaagccgagtgcatgagggtggagatggaggagctcctctacgcctacggtgtcgacgtcgtcttcaccggccacgtgcacgcgtacgagcggtcgaaccgggtgttcaactacacgctggacgcgtgcggccccgtgcacatctcggtgggcgacggcggcaaccgcgagaagatggcgacggcgcacgcggacgaggcgggccactgcccggacccggcgtcgacgccggaccccttcatggggggccgcctctgcgccgccaacttcacgtcgggccccgccgcgggccgcttctgctgggaccgccagccggagtacagcgcgtacagggagagcagcttcgggcacggcgtcctggaggtcaggaacgacacgcacgcgctctggcggtggcaccgcaaccaggacctccatgccgccgccgccgccaacgtcgccgccgacgaggtctacatcgtcagggagcccgacaagtgcctcgccaagacggccagattgttggcctatagcgagaaggacgagctgtgacctaggggccgccgcgctcgccaaaacgagcaagaagcaacaagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcggatacgatgctgtatgctactgaggcaagtcccataaataaataatgacacgtgcgtgttctataatctcttcgcttcttcagtgtccccttgcggagtttggcatccattgatgccgttacactgagaacataacggacacagtagacgaaccacttgagttcttgtatgaaattctgacccttttttttgaaggatcaggagggggaaacccctactggcctggtccttttacaatcaataaaaagaaaagaaaaagaaagaaaaaggaagagctatttctatatttgccacaaatttagccagttcgggattgaggtgtcgaattctccccgtgctctgtgaatgattagtcgcaattctctactaaattcctgagtacagcggagcacggagggatctctgtttgaaaacaaccactcgtttcggcttttccagatgctccaagtcataagaatagtgatctccatagagaagggaacgttgagctggtgtttgaggttcacagatgcctcttcagggttggaaattctgggtggggtaatgccaattgagttccagcaggctttcgcgaagttgcatctgaggaaaagatgataaagggtctcctctctttgccaaaggcagttttcgcaagagtaggaatctagctccatgtttctccttctcaacatatttctggtgtttagcctgttcttaagccacagccaatagaagactctatgcttaggctgacacttacttttccaaactagtttgtagataggatgagtttgcatctggcccatgaaagatctgtaagctttttgggacgacccggg

SEQ ID NO: 47 - DNA, 4039 bp, Artificial Sequence
  Synthetic construct, pAG4902
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgagggtgttgctcgttgccctcgctctcctggctctcgctgcgagcgccaccagcaccgcggttcccgccgagccggcgtcgacgctgtccgggccgtcgcggccggtgacggtggcgatcggagacaggggccacgcggtggacctgccggacacggacccgcgggtgcagcgccgcgtcacgggctgggcgcccgagcagatcgccgtcgcgctctccgcctcgcccacctccgcctgggtctcctggatcacaggggactaccagatgggcggcgccgtggagccgctggaccccggcgcggtgggcagcgtcgtgcggtacggcctcgccgccgacgccctcgaccacgaggccaccggggagtcgctcgtgtacagccagctgtacccgttcgagggcctccagaactacacctccggcatcatccaccacgtccgcctccagggcctggagcctgggaccaggtacttgtaccggtgcggcgacccggccatcccggacgccatgagcgacgtgcacgcgttccgcacgatgccggccgtcgggccggggagctacccagggcggatcgccgtggtcggggacctcgggctcacctacaacaccacctcgacggtggaccacttggtgcgcaaccgccccgacctggtgctcctcctcggcgacgtctgctacgccaacctgtacctgaccaacggcaccggggcggactgctactcctgcgccttcgccaagtccacgcccatccacgagacgtaccagccgcgctgggattactggggaaggtacatggagcccgtgacgtcgagcatcccgatgatggtggtggagggcaaccatgagatcgagcagcagatccacaacaggacgttcgcggcctacagctcgcggttcgcgttcccgtcggaggagagcgggtcctcctcgccgttctactactcgttcgacgccggcggcatccacttcgtcatgcttgcgtcctacgccgactacagcagatcaggtgcgcagtacaagtggctggaggcggacctggagaaggtggacaggtcggtgacgccatggctgatcgcgggctggcacgcgccctggtacaccacctacaaggctcactacagggaagccgagtgcatgagggtggagatggaggagctcctctacgcctacggtgtcgacgtcgtcttcaccggccacgtgcacgcgtacgagcggtcgaaccgggtgttcaactacacgctggacgcgtgcggccccgtgcacatctcggtgggcgacggcggcaaccgcgagaagatggcgacggcgcacgcggacgaggcgggccactgcccggacccggcgtcgacgccggaccccttcatggggggccgcctctgcgccgccaacttcacgtcgggccccgccgcgggccgcttctgctgggaccgccagccggagtacagcgcgtacagggagagcagcttcgggcacggcgtcctggaggtcaggaacgacacgcacgcgctctggcggtggcaccgcaaccaggacctccatgccgccgccgccgccaacgtcgccgccgacgaggtctacatcgtcagggagcccgacaagtgcctcgccaagacggccagattgttggcctatagcgagaaggacgagctgtgacctaggggccgccgcgctcgccaaaacgagcaagaagcaacaagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcggatacgatgctgtatgctactgaggcaagtcccataaataaataatgacacgtgcgtgttctataatctcttcgcttcttcagtgtccccttgcggagtttggcatccattgatgccgttacactgagaacataacggacacagtagacgaaccacttgagttcttgtatgaaattctgacccttttttttgaaggatcaggagggggaaacccctactggcctggtccttttacaatcaataaaaagaaaagaaaaagaaagaaaaaggaagagctatttctatatttgccacaaatttagccagttcgggattgaggtgtcgaattctccccgtgctctgtgaatgattagtcgcaattctctactaaattcctgagtacagcggagcacggagggatctctgtttgaaaacaaccactcgtttcggcttttccagatgctccaagtcataagaatagtgatctccatagagaagggaacgttgagctggtgtttgaggttcacagatgcctcttcagggttggaaattctgggtggggtaatgccaattgagttccagcaggctttcgcgaagttgcatctgaggaaaagatgataaagggtctcctctctttgccaaaggcagttttcgcaagagtaggaatctagctccatgtttctccttctcaacatatttctggtgtttagcctgttcttaagccacagccaatagaagactctatgcttaggctgacacttacttttccaaactagtttgtagataggatgagtttgcatctggcccatgaaagatctgtaagctttttgggacgacccggg

SEQ ID NO: 48 - DNA, 4661 bp, Artificial Sequence
  Synthetic construct, pAG4911
ataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatcctaaaccatgagggtgttgctcgttgccctcgctctcctggctctcgctgcgagcgccaccagcgagccggcgtcgacgctgtccgggccgtcgcggccggtgacggtggcgatcggagacaggggccacgcggtggacctgccggacacggacccgcgggtgcagcgccgcgtcacgggctgggcgcccgagcagatcgccgtcgcgctctccgcctcgcccacctccgcctgggtctcctggatcacaggggactaccagatgggcggcgccgtggagccgctggaccccggcgcggtgggcagcgtcgtgcggtacggcctcgccgccgacgccctcgaccacgaggccaccggggagtcgctcgtgtacagccagctgtacccgttcgagggcctccagaactacacctccggcatcatccaccacgtccgcctccagggcctggagcctgggaccaggtacttgtaccggtgcggcgacccggccatcccggacgccatgagcgacgtgcacgcgttccgcacgatgccggccgtcgggccggggagctacccggggcggatcgccgtggtcggggacctcgggctcacctacaacaccacctcgacggtggaccacttggtgcgcaaccgccccgacctggtgctcctcctcggcgacgtctgctacgccaacctgtacctgaccaacggcaccggggcggactgctactcctgcgccttcgccaagtccacgcccatccacgagacgtaccagccgcgctgggattactggggaaggtacatggagcccgtgacgtcgagcatcccgatgatggtggtggagggcaaccatgagatcgagcagcagatccacaacaggacgttcgcggcctacagctcgcggttcgcgttcccgtcggaggagagcgggtcctcctcgccgttctactactcgttcgacgccggcggcatccacttcgtcatgcttgcgtcctacgccgactacagcagatcaggtgcgcagtacaagtggctggaggcggacctggagaaggtggacaggtcggtgacgccatggctgatcgcgggctggcacgcgccctggtacaccacctacaaggctcactacagggaagccgagtgcatgagggtggagatggaggagctcctctacgcctacggtgtcgacgtcgtcttcaccggccacgtgcacgcgtacgagcggtcgaaccgggtgttcaactacacgctggacgcgtgcggccccgtgcacatctcggtgggcgacggcggcaaccgcgagaagatggcgacggcgcacgcggacgaggccggccactgcccggacccggcgtcgacgccggaccccttcatggggggccgcctctgcgccgccaacttcacgtcgggccccgccgcgggccgcttctgctgggaccgccagccggagtacagcgcgtacagggagagcagcttcgggcacggcgtcctggaggtcaggaacgacacgcacgcgctctggcggtggcaccgcaaccaggacctccatgccgccgccgccgccaacgtcgccgccgacgaggtctacatcgtcagggagcccgacaagtgcctcgccaagacggccagattgttggcctatagcgagaaggacgagctgtgacctaggggccgccgcgctcgccaaaacgagcaagaagcaacaagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcggatacgatgctgtatgctactgaggcaagtcccataaataaataatgacacgtgcgtgttctataatctcttcgcttcttcagtgtccccttgcggagtttggcatccattgatgccgttacactgagaacataacggacacagtagacgaaccacttgagttcttgtatgaaattctgacccttttttttgaaggatcaggagggggaaacccctactggcctggtccttttacaatcaataaaaagaaaagaaaaagaaagaaaaaggaagagctatttctatatttgccacaaatttagccagttcgggattgaggtgtcgaattctccccgtgctctgtgaatgattagtcgcaattctctactaaattcctgagtacagcggagcacggagggatctctgtttgaaaacaaccactcgtttcggcttttccagatgctccaagtcataagaatagtgatctccatagagaagggaacgttgagctggtgtttgaggttcacagatgcctcttcagggttggaaattctgggtggggtaatgccaattgagttccagcaggctttcgcgaagttgcatctgaggaaaagatgataaagggtctcctctctttgccaaaggcagttttcgcaagagtaggaatctagctccatgtttctccttctcaacatatttctggtgtttagcctgttcttaagccacagccaatagaagactctatgcttaggctgacacttacttttccaaactagtttgtagataggatgagtttgcatctggcccatgaaagatctgtaagctttttgggacgacccggg

SEQ ID NO: 49 - DNA, 4024 bp, Artificial Sequence
  Synthetic construct, pAG4903
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgagggtgttgctcgttgccctcgctctcctggctctcgctgcgagcgccaccagcgagccggcgtcgacgctgtccgggccgtcgcggccggtgacggtggcgatcggagacaggggccacgcggtggacctgccggacacggacccgcgggtgcagcgccgcgtcacgggctgggcgcccgagcagatcgccgtcgcgctctccgcctcgcccacctccgcctgggtctcctggatcacaggggactaccagatgggcggcgccgtggagccgctggaccccggcgcggtgggcagcgtcgtgcggtacggcctcgccgccgacgccctcgaccacgaggccaccggggagtcgctcgtgtacagccagctgtacccgttcgagggcctccagaactacacctccggcatcatccaccacgtccgcctccagggcctggagcctgggaccaggtacttgtaccggtgcggcgacccggccatcccggacgccatgagcgacgtgcacgcgttccgcacgatgccggccgtcgggccggggagctacccggggcggatcgccgtggtcggggacctcgggctcacctacaacaccacctcgacggtggaccacttggtgcgcaaccgccccgacctggtgctcctcctcggcgacgtctgctacgccaacctgtacctgaccaacggcaccggggcggactgctactcctgcgccttcgccaagtccacgcccatccacgagacgtaccagccgcgctgggattactggggaaggtacatggagcccgtgacgtcgagcatcccgatgatggtggtggagggcaaccatgagatcgagcagcagatccacaacaggacgttcgcggcctacagctcgcggttcgcgttcccgtcggaggagagcgggtcctcctcgccgttctactactcgttcgacgccggcggcatccacttcgtcatgcttgcgtcctacgccgactacagcagatcaggtgcgcagtacaagtggctggaggcggacctggagaaggtggacaggtcggtgacgccatggctgatcgcgggctggcacgcgccctggtacaccacctacaaggctcactacagggaagccgagtgcatgagggtggagatggaggagctcctctacgcctacggtgtcgacgtcgtcttcaccggccacgtgcacgcgtacgagcggtcgaaccgggtgttcaactacacgctggacgcgtgcggccccgtgcacatctcggtgggcgacggcggcaaccgcgagaagatggcgacggcgcacgcggacgaggccggccactgcccggacccggcgtcgacgccggaccccttcatggggggccgcctctgcgccgccaacttcacgtcgggccccgccgcgggccgcttctgctgggaccgccagccggagtacagcgcgtacagggagagcagcttcgggcacggcgtcctggaggtcaggaacgacacgcacgcgctctggcggtggcaccgcaaccaggacctccatgccgccgccgccgccaacgtcgccgccgacgaggtctacatcgtcagggagcccgacaagtgcctcgccaagacggccagattgttggcctatagcgagaaggacgagctgtgacctaggggccgccgcgctcgccaaaacgagcaagaagcaacaagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcggatacgatgctgtatgctactgaggcaagtcccataaataaataatgacacgtgcgtgttctataatctcttcgcttcttcagtgtccccttgcggagtttggcatccattgatgccgttacactgagaacataacggacacagtagacgaaccacttgagttcttgtatgaaattctgacccttttttttgaaggatcaggagggggaaacccctactggcctggtccttttacaatcaataaaaagaaaagaaaaagaaagaaaaaggaagagctatttctatatttgccacaaatttagccagttcgggattgaggtgtcgaattctccccgtgctctgtgaatgattagtcgcaattctctactaaattcctgagtacagcggagcacggagggatctctgtttgaaaacaaccactcgtttcggcttttccagatgctccaagtcataagaatagtgatctccatagagaagggaacgttgagctggtgtttgaggttcacagatgcctcttcagggttggaaattctgggtggggtaatgccaattgagttccagcaggctttcgcgaagttgcatctgaggaaaagatgataaagggtctcctctctttgccaaaggcagttttcgcaagagtaggaatctagctccatgtttctccttctcaacatatttctggtgtttagcctgttcttaagccacagccaatagaagactctatgcttaggctgacacttacttttccaaactagtttgtagataggatgagtttgcatctggcccatgaaagatctgtaagctttttgggacgacccggg

SEQ ID NO: 50 - DNA, 4181 bp, Artificial Sequence
  Synthetic construct, pAG4908
ataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatcctaaaccatgagggtgttgctcgttgccctcgctctcctggctctcgctgcgagcgccaccagcgccgggatgactgatctgctgatgctgaccgacaagtcgcagctgcaggcgctagcgatgctgctgcggaacaacgaggagctcatgatgagccaagcgatcaagtcggagacggagcgcgttgagtacctcaagacggtgagcgactgctacacgcggacaatgaagctccttgacgactccatggcggccaggatcacgtacgagcgttcgggcggaacgaggagcctcgtcgcgcgggacatggacgactacgtcgtctacggcctcaacgcgtgcttgcagaacgtccgcaactgctgcgtgcgtctggacgccatcgacaagctgcgggcgcactacgacgccctcgccgacgccgtcgccgaaccggccgccaacgtcgagggcctcgccgcggaggcgtccgagtacaaggccgccatgtggcagtactgctacaaccagcggagcgcctccgcgcgggcgcactcccgcgcctactcccaggcgctcaagctggagggcatcgacttcgccgagcttgtgcggaggcaccagctccggctcgggtacggcagcaagggcgaggagttcgaggacctggacgacacccagaagctggaggtgtacaacagcatcatcgtcgagtcggggcgggcggggctaccggtgcggatgttctcgtcgggccgctctgccggtggccctaagattgcagccacgacgtgggcgcaggcggtgagcgtcttcatcatggcggcgggcaacctggcgtgggacgtgttcaccacggagcacgaggtggaggccatcctcaagggcagcctcaacctcctggcggggctagggggcttcgccgtggaggccgtcgtcggcgcggctgtcaccaaggcggtcgcaaacgtcggcgccggcgtctttgcttgctctctcgcgggcttcgtcgtgggcgccatagccgggctgatcttcatcggcgtcagcggcctcctcattaacctcatcatcggctccccgaggaaggtgcctgacatgagcaagctcatgttccacaccgccgtcatgcccgatggaatggcccttgcgtatgcggtatctcatagcgagaaggacgagctgtaacctaggggccgccgcgctcgccaaaacgagcaagaagcaacaagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcggatacgatgctgtatgctactgaggcaagtcccataaataaataatgacacgtgcgtgttctataatctcttcgcttcttcagtgtccccttgcggagtttggcatccattgatgccgttacactgagaacataacggacacagtagacgaaccacttgagttcttgtatgaaattctgacccttttttttgaaggatcaggagggggaaacccctactggcctggtccttttacaatcaataaaaagaaaagaaaaagaaagaaaaaggaagagctatttctatatttgccacaaatttagccagttcgggattgaggtgtcgaattctccccgtgctctgtgaatgattagtcgcaattctctactaaattcctgagtacagcggagcacggagggatctctgtttgaaaacaaccactcgtttcggcttttccagatgctccaagtcataagaatagtgatctccatagagaagggaacgttgagctggtgtttgaggttcacagatgcctcttcagggttggaaattctgggtggggtaatgccaattgagttccagcaggctttcgcgaagttgcatctgaggaaaagatgataaagggtctcctctctttgccaaaggcagttttcgcaagagtaggaatctagctccatgtttctccttctcaacatatttctggtgtttagcctgttcttaagccacagccaatagaagactctatgcttaggctgacacttacttttccaaactagtttgtagataggatgagtttgcatctggcccatgaaagatctgtaagctttttgggacgacccggg

SEQ ID NO: 51 - DNA, 3544 bp, Artificial Sequence
  Synthetic construct, pAG4900
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgagggtgttgctcgttgccctcgctctcctggctctcgctgcgagcgccaccagcgccgggatgactgatctgctgatgctgaccgacaagtcgcagctgcaggcgctagcgatgctgctgcggaacaacgaggagctcatgatgagccaagcgatcaagtcggagacggagcgcgttgagtacctcaagacggtgagcgactgctacacgcggacaatgaagctccttgacgactccatggcggccaggatcacgtacgagcgttcgggcggaacgaggagcctcgtcgcgcgggacatggacgactacgtcgtctacggcctcaacgcgtgcttgcagaacgtccgcaactgctgcgtgcgtctggacgccatcgacaagctgcgggcgcactacgacgccctcgccgacgccgtcgccgaaccggccgccaacgtcgagggcctcgccgcggaggcgtccgagtacaaggccgccatgtggcagtactgctacaaccagcggagcgcctccgcgcgggcgcactcccgcgcctactcccaggcgctcaagctggagggcatcgacttcgccgagcttgtgcggaggcaccagctccggctcgggtacggcagcaagggcgaggagttcgaggacctggacgacacccagaagctggaggtgtacaacagcatcatcgtcgagtcggggcgggcggggctaccggtgcggatgttctcgtcgggccgctctgccggtggccctaagattgcagccacgacgtgggcgcaggcggtgagcgtcttcatcatggcggcgggcaacctggcgtgggacgtgttcaccacggagcacgaggtggaggccatcctcaagggcagcctcaacctcctggcggggctagggggcttcgccgtggaggccgtcgtcggcgcggctgtcaccaaggcggtcgcaaacgtcggcgccggcgtctttgcttgctctctcgcgggcttcgtcgtgggcgccatagccgggctgatcttcatcggcgtcagcggcctcctcattaacctcatcatcggctccccgaggaaggtgcctgacatgagcaagctcatgttccacaccgccgtcatgcccgatggaatggcccttgcgtatgcggtatctcatagcgagaaggacgagctgtaacctaggggccgccgcgctcgccaaaacgagcaagaagcaacaagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcggatacgatgctgtatgctactgaggcaagtcccataaataaataatgacacgtgcgtgttctataatctcttcgcttcttcagtgtccccttgcggagtttggcatccattgatgccgttacactgagaacataacggacacagtagacgaaccacttgagttcttgtatgaaattctgacccttttttttgaaggatcaggagggggaaacccctactggcctggtccttttacaatcaataaaaagaaaagaaaaagaaagaaaaaggaagagctatttctatatttgccacaaatttagccagttcgggattgaggtgtcgaattctccccgtgctctgtgaatgattagtcgcaattctctactaaattcctgagtacagcggagcacggagggatctctgtttgaaaacaaccactcgtttcggcttttccagatgctccaagtcataagaatagtgatctccatagagaagggaacgttgagctggtgtttgaggttcacagatgcctcttcagggttggaaattctgggtggggtaatgccaattgagttccagcaggctttcgcgaagttgcatctgaggaaaagatgataaagggtctcctctctttgccaaaggcagttttcgcaagagtaggaatctagctccatgtttctccttctcaacatatttctggtgtttagcctgttcttaagccacagccaatagaagactctatgcttaggctgacacttacttttccaaactagtttgtagataggatgagtttgcatctggcccatgaaagatctgtaagctttttgggacgacccggg

SEQ ID NO: 52 - DNA, 4184 bp, Artificial Sequence
  Synthetic construct, pAG4909
ataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatcctaaaccatgagggtgttgctcgttgccctcgctctcctggctctcgctgcgagcgccaccagcgccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacgtacgagcgttcgggcggaacgaggagcctcgtcgcgcgggacatggacgactacgtcgtctacggcctcaacgcgtgcttgcagaacgtccgcaactgctgcgtgcgcctggacgccatcgacaagctgcgggcgcactacgacgccctcgccgacgccgtcgccgacccggccgccaacgtcgagggcctcgccgcggaggcgtccgagtacaaggccgccatgtggcagtactgctacaaccagcggagcgcctccgcgcgggcgcactcccgcgcctactcccaggcgctcaagctggagggcatcgacttcgccgagctggtgcggaggcaccagctccggctcgggtacggcagcaagggcgaggagttcgaggacctggacgacacccagaagctggaggtgtacaaacagcatcatcgtcgagtcggggcggggcgggggctaccggtgcggatgttctcgtcgggccgctctgccggtggccctaagattgcagccacgacgtgggcggaggcggtgagcgtcttcatcatggcggcgggcaacctggcgtgggacgtgttcaccacggagcacgaggtggaggccatcctcaagggcagcctcaacctcctggcggggctagggggcttcgccgtggaggccgtcgtcggcgcggctgtcaccaaggcggtcgcaaacgtcggcgccggcgtctttgcttgctctctcgccggcttcgtcgtgggcgccatcgccgggctgatcttcgtcggcgtcagcggcctcctcattaacctcatcatcggctccccaaggaaggtgcctgacatgagcaagctcatgttccacaccgccgtcatgcccgatggaatggcccttgcgtatgcggtatctcatagcgagaaggacgagctgtaacctaggggccgccgcgctcgccaaaacgagcaagaagcaacaagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcggatacgatgctgtatgctactgaggcaagtcccataaataaataatgacacgtgcgtgttctataatctcttcgcttcttcagtgtccccttgcggagtttggcatccattgatgccgttacactgagaacataacggacacagtagacgaaccacttgagttcttgtatgaaattctgacccttttttttgaaggatcaggagggggaaacccctactggcctggtccttttacaatcaataaaaagaaaagaaaaagaaagaaaaaggaagagctatttctatatttgccacaaatttagccagttcgggattgaggtgtcgaattctccccgtgctctgtgaatgattagtcgcaattctctactaaattcctgagtacagcggagcacggagggatctctgtttgaaaacaaccactcgtttcggcttttccagatgctccaagtcataagaatagtgatctccatagagaagggaacgttgagctggtgtttgaggttcacagatgcctcttcagggttggaaattctgggtggggtaatgccaattgagttccagcaggctttcgcgaagttgcatctgaggaaaagatgataaagggtctcctctctttgccaaaggcagttttcgcaagagtaggaatctagctccatgtttctccttctcaacatatttctggtgtttagcctgttcttaagccacagccaatagaagactctatgcttaggctgacacttacttttccaaactagtttgtagataggatgagtttgcatctggcccatgaaagatctgtaagctttttgggacgacccggg

SEQ ID NO: 53 - DNA, 3547 bp, Artificial Sequence
  Synthetic construct, pAG4901
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgagggtgttgctcgttgccctcgctctcctggctctcgctgcgagcgccaccagcgccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacgtacgagcgttcgggcggaacgaggagcctcgtcgcgcgggacatggacgactacgtcgtctacggcctcaacgcgtgcttgcagaacgtccgcaactgctgcgtgcgcctggacgccatcgacaagctgcgggcgcactacgacgccctcgccgacgccgtcgccgacccggccgccaacgtcgagggcctcgccgcggaggcgtccgagtacaaggccgccatgtggcagtactgctacaaccagcggagcgcctccgcgcgggcgcactcccgcgcctactcccaggcgctcaagctggagggcatcgacttcgccgagctggtgcggaggcaccagctccggctcgggtacggcagcaagggcgaggagttcgaggacctggacgacacccagaagctggaggtgtacaaacagcatcatcgtcgagtcggggcggggcgggggctaccggtgcggatgttctcgtcgggccgctctgccggtggccctaagattgcagccacgacgtgggcggaggcggtgagcgtcttcatcatggcggcgggcaacctggcgtgggacgtgttcaccacggagcacgaggtggaggccatcctcaagggcagcctcaacctcctggcggggctagggggcttcgccgtggaggccgtcgtcggcgcggctgtcaccaaggcggtcgcaaacgtcggcgccggcgtctttgcttgctctctcgccggcttcgtcgtgggcgccatcgccgggctgatcttcgtcggcgtcagcggcctcctcattaacctcatcatcggctccccaaggaaggtgcctgacatgagcaagctcatgttccacaccgccgtcatgcccgatggaatggcccttgcgtatgcggtatctcatagcgagaaggacgagctgtaacctaggggccgccgcgctcgccaaaacgagcaagaagcaacaagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcggatacgatgctgtatgctactgaggcaagtcccataaataaataatgacacgtgcgtgttctataatctcttcgcttcttcagtgtccccttgcggagtttggcatccattgatgccgttacactgagaacataacggacacagtagacgaaccacttgagttcttgtatgaaattctgacccttttttttgaaggatcaggagggggaaacccctactggcctggtccttttacaatcaataaaaagaaaagaaaaagaaagaaaaaggaagagctatttctatatttgccacaaatttagccagttcgggattgaggtgtcgaattctccccgtgctctgtgaatgattagtcgcaattctctactaaattcctgagtacagcggagcacggagggatctctgtttgaaaacaaccactcgtttcggcttttccagatgctccaagtcataagaatagtgatctccatagagaagggaacgttgagctggtgtttgaggttcacagatgcctcttcagggttggaaattctgggtggggtaatgccaattgagttccagcaggctttcgcgaagttgcatctgaggaaaagatgataaagggtctcctctctttgccaaaggcagttttcgcaagagtaggaatctagctccatgtttctccttctcaacatatttctggtgtttagcctgttcttaagccacagccaatagaagactctatgcttaggctgacacttacttttccaaactagtttgtagataggatgagtttgcatctggcccatgaaagatctgtaagctttttgggacgacccggg

SEQ ID NO: 54 - DNA, 3605 bp, Artificial Sequence
  Synthetic construct, pAG4728
ataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 55 - DNA, 3611 bp, Artificial Sequence
  Synthetic construct, pAG4813
ataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctggacgagctgaaggccgaggccaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 56 - DNA, 3605 bp, Artificial Sequence
  Synthetic construct, pAG4729
ataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 57 - DNA, 3611 bp, Artificial Sequence
  Synthetic construct, pAG4814
ataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctggacgagctgaaggccgaggccaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 58 - DNA, 3605 bp, Artificial Sequence
  Synthetic construct, pAG4718
ataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaaggccacgcagctcatgcaggacgtgaccccggacgcctggccgacctggccggtgaagctcggcgagctgaccccgcgcggcggcgagctgatcgcctacctcggccactactggcgccagcgcctcgtggccgacggcctcctcccgaagtgcggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacaacgccaacgtgaccgacgccatcctggagcgcgccggcggctccatcgccgacttcaccggccactaccagaccgccttccgcgagctggagcgcgtgctcaacttcccgcagtcgaacctctgcctcaagcgcgagaagcaggacgagtcctgctccctcacccaggccctcccgtccgagctgaaggtgtccgccgactgcgtgtccctcaccggcgccgtgtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgaactggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctctccctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 59 - DNA, 2968 bp, Artificial Sequence
  Synthetic construct, pAG4263
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 60 - DNA, 7262 bp, Artificial Sequence
  Synthetic construct, pAG4915
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaagttcacgcagctcatgcaggacgtgaccccggacgccttctacacctggccggtgaagctcggcgagctgaccccgcgcggcggcgagctgatcgcctacctcggccactactggcgccagcgcctcgtggccgacggcctcctcccgaagaagggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacgtggcccaggtgaccgacgccatcctggagcgcgccggcggctccatcgccgacttcaccggccactaccagaccgccttccgcgagctggagcgcgtgctcaacttcccgcagtcgaacctcgccctcaagcgcgagaagcaggacgagtccgcctccctcacccaggccctcccgtccgagctgaaggtgtccgccgacaacgtgtccctcaccggcgcctggtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgcagtggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctcttcctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacctccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaagttcacgcagctcatgcaggacgtgaccccggacgccttctacacctggccggtgaagctcggcgagctgaccccgcgcggcggcgagctgatcgcctacctcggccactactggcgccagcgcctcgtggccgacggcctcctcccgaagaagggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacgtggcccaggtgaccgacgccatcctggagcgcgccggcggctccatcgccgacttcaccggccactaccagaccgccttccgcgagctggagcgcgtgctcaacttcccgcagtcgaacctcgccctcaagcgcgagaagcaggacgagtccgcctccctcacccaggccctcccgtccgagctgaaggtgtccgccgacaacgtgtccctcaccggcgcctggtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgcagtggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctcttcctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggctgcacaaagtggagtagtcagtcatcgatcaggaaccagacaccagacttttattcatacagtgaagtgaagtgaagtgcagtgcagtgagttgctggtttttgtacaacttagtatgtatttgtatttgtaaaatacttctatcaataaaatttctaattcctaaaaccaaaatccag

SEQ ID NO: 61 - DNA, 2974 bp, Artificial Sequence
  Synthetic construct, pAG4284
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctggacgagctgaaggccgaggccaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 62 - DNA, 2968 bp, Artificial Sequence
  Synthetic construct, pAG4913
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaagttcacgcagctcatgcaggacgtgaccccggacgccttctacacctggccggtgaagctcggcgagctgaccccgcgcggcggcgagctgatcgcctacctcggccactactggcgccagcgcctcgtggccgacggcctcctcccgaagaagggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacgtggcccaggtgaccgacgccatcctggagcgcgccggcggctccatcgccgacttcaccggccactaccagaccgccttccgcgagctggagcgcgtgctcaacttcccgcagtcgaacctcgccctcaagcgcgagaagcaggacgagtccgcctccctcacccaggccctcccgtccgagctgaaggtgtccgccgacaacgtgtccctcaccggcgcctggtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgcagtggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctcttcctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 63 - DNA, 2968 bp, Artificial Sequence
  Synthetic construct, pAG4265
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 64 - DNA, 6650 bp, Artificial Sequence
  Synthetic construct, pAG4916
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaagttcacgcagctcatgcaggacgtgaccccggacgccttctacacctggccggtgaagctcggcgagctgaccccgcgcggcggcgagctgatcgcctacctcggccactactggcgccagcgcctcgtggccgacggcctcctcccgaagaagggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacgtggcccaggtgaccgacgccatcctggagcgcgccggcggctccatcgccgacttcaccggccactaccagaccgccttccgcgagctggagcgcgtgctcaacttcccgcagtcgaacctcgccctcaagcgcgagaagcaggacgagtccgcctccctcacccaggccctcccgtccgagctgaaggtgtccgccgacaacgtgtccctcaccggcgcctggtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgcagtggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctcttcctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaagttcacgcagctcatgcaggacgtgaccccggacgccttctacacctggccggtgaagctcggcgagctgaccccgcgcggcggcgagctgatcgcctacctcggccactactggcgccagcgcctcgtggccgacggcctcctcccgaagaagggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacgtggcccaggtgaccgacgccatcctggagcgcgccggcggctccatcgccgacttcaccggccactaccagaccgccttccgcgagctggagcgcgtgctcaacttcccgcagtcgaacctcgccctcaagcgcgagaagcaggacgagtccgcctccctcacccaggccctcccgtccgagctgaaggtgtccgccgacaacgtgtccctcaccggcgcctggtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgcagtggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctcttcctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 65 - DNA, 2974 bp, Artificial Sequence
  Synthetic construct, pAG4285
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctggacgagctgaaggccgaggccaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 66 - DNA, 2968 bp, Artificial Sequence
  Synthetic construct, pAG4259
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaaggccacgcagctcatgcaggacgtgaccccggacgcctggccgacctggccggtgaagctcggcgagctgaccccgcgcggcggcgagctgatcgcctacctcggccactactggcgccagcgcctcgtggccgacggcctcctcccgaagtgcggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacaacgccaacgtgaccgacgccatcctggagcgcgccggcggctccatcgccgacttcaccggccactaccagaccgccttccgcgagctggagcgcgtgctcaacttcccgcagtcgaacctctgcctcaagcgcgagaagcaggacgagtcctgctccctcacccaggccctcccgtccgagctgaaggtgtccgccgactgcgtgtccctcaccggcgccgtgtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgaactggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctctccctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 67 - DNA, 2962 bp, Artificial Sequence
  Synthetic construct, pAG4292
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatccaccatgagggtgttgctcgttgccctcgctctcctggctctcgctgcgagcgccaccagccagtcggagcctgagctgaagctggagtcggtcgtcatcgtttcccggcacggcgttagggccccaaccaagttcacacagctgatgcaggacgtgacccccgatgcttggccaacctggcctgtcaagctcggcgagctgacccccaggggcggggagctcatcgcgtacctggggcactactggcgccagcggctggtcgctgacggcctcctgccaaaggttggctgccctcagtctgggcaggtggctatcattgccgacgtcgatgagcgcaccaggaagacgggcgaggccttcgccgcggggctcgccccagactgcgctatcaccgtgcaccatcaggcggacacgtccagcccagatcctctcttcaacccgctgaagaccggcgtctgccagctggacgtggcgaatgtccgcagggctatcctggagagggccggcgggtccattgccgatttcacaaggcattaccagactgcgttcagggagctggagcgggtgctgaacttcccgcagagcaatctctgcctgaagcgcgagaagcaggacgagtcgtgctctctcacgcaggccctgccctctgagctcaaggtctcagcggacgatgtttccctgacaggcgcctggtcactggcgtccatgctcactgagattttcctcctgcagcaggctcaggggatgccggagccaggctgggggcggattacagacagccaccagtggaacactctcctgtcgctccataatgcggttttcgatctcctgcagaggacccccgaggtggctcggtcgcgcgccacgcccctcctggacctgatcaagacagctctcactccacacccgccccagaagcaggcctacggcgttaccctgcctacgtccgtgctcttcattgccggccatgataccaacctcgctaatctgggcggggccctggagctgaactggaccctgccgggccagcccgacaattacccacctggcggggagctggtgttcgagaggtggaggcgcctcagcgataactcgcagtggattcaggtgtccctcgtgttccagacactccagcagatgcgggacaagacaccgctctcactgaacactccgcccggcgaggtcaagctcacgctggccgggtgcgaggagaggaacgctcagggcatgtgctccctggctgggttcacacagattgtcaacgaggcccgcatccccgcttgctctctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 68 - DNA, 3580 bp, Artificial Sequence
  Synthetic construct, pAG4726
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggctgcacaaagtggagtagtcagtcatcgatcaggaaccagacaccagacttttattcatacagtgaagtgaagtgaagtgcagtgcagtgagttgctggtttttgtacaacttagtatgtatttgtatttgtaaaatacttctatcaataaaatttctaattcctaaaaccaaaatccag

SEQ ID NO: 69 - DNA, 3586 bp, Artificial Sequence
  Synthetic construct, pAG4799
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctggacgagctgaaggccgaggccaagtgacctaggctgcacaaagtggagtagtcagtcatcgatcaggaaccagacaccagacttttattcatacagtgaagtgaagtgaagtgcagtgcagtgagttgctggtttttgtacaacttagtatgtatttgtatttgtaaaatacttctatcaataaaatttctaattcctaaaaccaaaatccag

SEQ ID NO: 70 - DNA, 3580 bp, Artificial Sequence
  Synthetic construct, pAG4912
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaagttcacgcagctcatgcaggacgtgaccccggacgccttctacacctggccggtgaagctcggcgagctgaccccgcgcggcggcgagctgatcgcctacctcggccactactggcgccagcgcctcgtggccgacggcctcctcccgaagaagggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacgtggcccaggtgaccgacgccatcctggagcgcgccggcggctccatcgccgacttcaccggccactaccagaccgccttccgcgagctggagcgcgtgctcaacttcccgcagtcgaacctcgccctcaagcgcgagaagcaggacgagtccgcctccctcacccaggccctcccgtccgagctgaaggtgtccgccgacaacgtgtccctcaccggcgcctggtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgcagtggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctcttcctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggctgcacaaagtggagtagtcagtcatcgatcaggaaccagacaccagacttttattcatacagtgaagtgaagtgaagtgcagtgcagtgagttgctggtttttgtacaacttagtatgtatttgtatttgtaaaatacttctatcaataaaatttctaattcctaaaaccaaaatccag

SEQ ID NO: 71 - DNA, 3580 bp, Artificial Sequence
  Synthetic construct, pAG4727
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggctgcacaaagtggagtagtcagtcatcgatcaggaaccagacaccagacttttattcatacagtgaagtgaagtgaagtgcagtgcagtgagttgctggtttttgtacaacttagtatgtatttgtatttgtaaaatacttctatcaataaaatttctaattcctaaaaccaaaatccag

SEQ ID NO: 72 - DNA, 3586 bp, Artificial Sequence
  Synthetic construct, pAG4801
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctggacgagctgaaggccgaggccaagtgacctaggctgcacaaagtggagtagtcagtcatcgatcaggaaccagacaccagacttttattcatacagtgaagtgaagtgaagtgcagtgcagtgagttgctggtttttgtacaacttagtatgtatttgtatttgtaaaatacttctatcaataaaatttctaattcctaaaaccaaaatccag

SEQ ID NO: 73 - DNA, 3580 bp, Artificial Sequence
  Synthetic construct, pAG4717
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaaggccacgcagctcatgcaggacgtgaccccggacgcctggccgacctggccggtgaagctcggcgagctgaccccgcgcggcggcgagctgatcgcctacctcggccactactggcgccagcgcctcgtggccgacggcctcctcccgaagtgcggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacaacgccaacgtgaccgacgccatcctggagcgcgccggcggctccatcgccgacttcaccggccactaccagaccgccttccgcgagctggagcgcgtgctcaacttcccgcagtcgaacctctgcctcaagcgcgagaagcaggacgagtcctgctccctcacccaggccctcccgtccgagctgaaggtgtccgccgactgcgtgtccctcaccggcgccgtgtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgaactggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctctccctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggctgcacaaagtggagtagtcagtcatcgatcaggaaccagacaccagacttttattcatacagtgaagtgaagtgaagtgcagtgcagtgagttgctggtttttgtacaacttagtatgtatttgtatttgtaaaatacttctatcaataaaatttctaattcctaaaaccaaaatccag

SEQ ID NO: 74 - DNA, 3586 bp, Artificial Sequence
  Synthetic construct, pAG4802
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaaggccacgcagctcatgcaggacgtgaccccggacgcctggccgacctggccggtgaagctcggcgagctgaccccgcgcggcggcgagctgatcgcctacctcggccactactggcgccagcgcctcgtggccgacggcctcctcccgaagtgcggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacaacgccaacgtgaccgacgccatcctggagcgcgccggcggctccatcgccgacttcaccggccactaccagaccgccttccgcgagctggagcgcgtgctcaacttcccgcagtcgaacctctgcctcaagcgcgagaagcaggacgagtcctgctccctcacccaggccctcccgtccgagctgaaggtgtccgccgactgcgtgtccctcaccggcgccgtgtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgaactggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctctccctcaacaccccgccgggcgaggtgaagctcaccctggccggctgcgaggagcgcaacgcgcagggcatgtgctccctcgccggcttcacccagatcgtgaacgaggcccgcatcccggcctgctccctcgacgagctgaaggccgaggccaagtaacctaggctgcacaaagtggagtagtcagtcatcgatcaggaaccagacaccagacttttattcatacagtgaagtgaagtgaagtgcagtgcagtgagttgctggtttttgtacaacttagtatgtatttgtatttgtaaaatacttctatcaataaaatttctaattcctaaaaccaaaatccag

SEQ ID NO: 75 - DNA, 3079 bp, Artificial Sequence
  Synthetic construct, pAG4268
tacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 76 - DNA, 3079 bp, Artificial Sequence
  Synthetic construct, pAG4294
tacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaagttcacgcagctcatgcaggacgtgaccccggacgccttctacacctggccggtgaagctcggcgagctgaccccgcgcggcggcgagctgatcgcctacctcggccactactggcgccagcgcctcgtggccgacggcctcctcccgaagaagggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacgtggcccaggtgaccgacgccatcctggagcgcgccggcggctccatcgccgacttcaccggccactaccagaccgccttccgcgagctggagcgcgtgctcaacttcccgcagtcgaacctcgccctcaagcgcgagaagcaggacgagtccgcctccctcacccaggccctcccgtccgagctgaaggtgtccgccgacaacgtgtccctcaccggcgcctggtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgcagtggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctcttcctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 77 - DNA, 3079 bp, Artificial Sequence
  Synthetic construct, pAG4269
tacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 78 - DNA, 3079 bp, Artificial Sequence
  Synthetic construct, pAG4267
tacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaaggccacgcagctcatgcaggacgtgaccccggacgcctggccgacctggccggtgaagctcggcgagctgaccccgcgcggcggcgagctgatcgcctacctcggccactactggcgccagcgcctcgtggccgacggcctcctcccgaagtgcggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacaacgccaacgtgaccgacgccatcctggagcgcgccggcggctccatcgccgacttcaccggccactaccagaccgccttccgcgagctggagcgcgtgctcaacttcccgcagtcgaacctctgcctcaagcgcgagaagcaggacgagtcctgctccctcacccaggccctcccgtccgagctgaaggtgtccgccgactgcgtgtccctcaccggcgccgtgtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgaactggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctctccctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 79 - DNA, 3073 bp, Artificial Sequence
  Synthetic construct, pAG4293
tacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctggatccaccatgagggtgttgctcgttgccctcgctctcctggctctcgctgcgagcgccaccagccagtcggagcctgagctgaagctggagtcggtcgtcatcgtttcccggcacggcgttagggccccaaccaagttcacacagctgatgcaggacgtgacccccgatgcttggccaacctggcctgtcaagctcggcgagctgacccccaggggcggggagctcatcgcgtacctggggcactactggcgccagcggctggtcgctgacggcctcctgccaaaggttggctgccctcagtctgggcaggtggctatcattgccgacgtcgatgagcgcaccaggaagacgggcgaggccttcgccgcggggctcgccccagactgcgctatcaccgtgcaccatcaggcggacacgtccagcccagatcctctcttcaacccgctgaagaccggcgtctgccagctggacgtggcgaatgtccgcagggctatcctggagagggccggcgggtccattgccgatttcacaaggcattaccagactgcgttcagggagctggagcgggtgctgaacttcccgcagagcaatctctgcctgaagcgcgagaagcaggacgagtcgtgctctctcacgcaggccctgccctctgagctcaaggtctcagcggacgatgtttccctgacaggcgcctggtcactggcgtccatgctcactgagattttcctcctgcagcaggctcaggggatgccggagccaggctgggggcggattacagacagccaccagtggaacactctcctgtcgctccataatgcggttttcgatctcctgcagaggacccccgaggtggctcggtcgcgcgccacgcccctcctggacctgatcaagacagctctcactccacacccgccccagaagcaggcctacggcgttaccctgcctacgtccgtgctcttcattgccggccatgataccaacctcgctaatctgggcggggccctggagctgaactggaccctgccgggccagcccgacaattacccacctggcggggagctggtgttcgagaggtggaggcgcctcagcgataactcgcagtggattcaggtgtccctcgtgttccagacactccagcagatgcgggacaagacaccgctctcactgaacactccgcccggcgaggtcaagctcacgctggccgggtgcgaggagaggaacgctcagggcatgtgctccctggctgggttcacacagattgtcaacgaggcccgcatccccgcttgctctctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 80 - DNA, 3082 bp, Artificial Sequence
  Synthetic construct, pAG4891
tacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctatggccaccatcgctttctcccgcttgtccatctacttctgcgtgcttctcctgtgccacggctccatggccgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 81 - DNA, 3091 bp, Artificial Sequence
  Synthetic construct, pAG4270
tacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctatggccaccatcgctttctcccgcttgtccatctacttctgcgtgcttctcctgtgccacggctccatggcccagctcgctgcgcagtccgagccggagctgaagctggagtccgtggtgatcgtgtcgcgccacggggtgcgcgccccgaccaaggccacgcagctcatgcaggacgtgaccccggacgcctggccgacctggccggtgaagctcggcgagctgaccccgcgcggcggcgagctgatcgcctacctcggccactactggcgccagcgcctcgtggccgacggcctcctcccgaagtgcggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacaacgccaacgtgaccgacgccatcctggagcgcgccggcggctccatcgccgacttcaccggccactaccagaccgccttccgcgagctggagcgcgtgctcaacttcccgcagtcgaacctctgcctcaagcgcgagaagcaggacgagtcctgctccctcacccaggccctcccgtccgagctgaaggtgtccgccgactgcgtgtccctcaccggcgccgtgtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgaactggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctctccctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 82 - DNA, 7305 bp, Artificial Sequence
  Synthetic construct, pAG4815
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccatcaatcccgggataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctggacgagctgaaggccgaggccaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 83 - DNA, 5942 bp, Artificial Sequence
  Synthetic construct, pAG4281
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 84 - DNA, 6056 bp, Artificial Sequence
  Synthetic construct, pAG4892
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacctacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctatggccaccatcgctttctcccgcttgtccatctacttctgcgtgcttctcctgtgccacggctccatggccgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 85 - DNA, 7305 bp, Artificial Sequence
  Synthetic construct, pAG4803
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctggacgagctgaaggccgaggccaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccatcaatcccgggataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 86 - DNA, 7305 bp, Artificial Sequence
  Synthetic construct, pAG4816
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccatcaatcccgggataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctggacgagctgaaggccgaggccaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 87 - DNA, 5942 bp, Artificial Sequence
  Synthetic construct, pAG4282
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 88 - DNA, 7305 bp, Artificial Sequence
  Synthetic construct, pAG4810
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctggacgagctgaaggccgaggccaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccatcaatcccgggataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 89 - DNA, 6579 bp, Artificial Sequence
  Synthetic construct, pAG4798
ataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaaggccacgcagctcatgcaggacgtgaccccggacgcctggccgacctggccggtgaagctcggcgagctgaccccgcgcggcggcgagctgatcgcctacctcggccactactggcgccagcgcctcgtggccgacggcctcctcccgaagtgcggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacaacgccaacgtgaccgacgccatcctggagcgcgccggcggctccatcgccgacttcaccggccactaccagaccgccttccgcgagctggagcgcgtgctcaacttcccgcagtcgaacctctgcctcaagcgcgagaagcaggacgagtcctgctccctcacccaggccctcccgtccgagctgaaggtgtccgccgactgcgtgtccctcaccggcgccgtgtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgaactggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctctccctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaaggccacgcagctcatgcaggacgtgaccccggacgcctggccgacctggccggtgaagctcggcgagctgaccccgcgcggcggcgagctgatcgcctacctcggccactactggcgccagcgcctcgtggccgacggcctcctcccgaagtgcggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacaacgccaacgtgaccgacgccatcctggagcgcgccggcggctccatcgccgacttcaccggccactaccagaccgccttccgcgagctggagcgcgtgctcaacttcccgcagtcgaacctctgcctcaagcgcgagaagcaggacgagtcctgctccctcacccaggccctcccgtccgagctgaaggtgtccgccgactgcgtgtccctcaccggcgccgtgtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgaactggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctctccctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 90 - DNA, 7247 bp, Artificial Sequence
  Synthetic construct, pAG4797
ataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaaggccacgcagctcatgcaggacgtgaccccggacgcctggccgacctggccggtgaagctcggcgagctgaccccgcgcggcggcgagctgatcgcctacctcggccactactggcgccagcgcctcgtggccgacggcctcctcccgaagtgcggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacaacgccaacgtgaccgacgccatcctggagcgcgccggcggctccatcgccgacttcaccggccactaccagaccgccttccgcgagctggagcgcgtgctcaacttcccgcagtcgaacctctgcctcaagcgcgagaagcaggacgagtcctgctccctcacccaggccctcccgtccgagctgaaggtgtccgccgactgcgtgtccctcaccggcgccgtgtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgaactggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctctccctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgatcgcttcatgtctaactcgagttactggtacgtaccaaatccatggaatcaaggtacctccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaaggccacgcagctcatgcaggacgtgaccccggacgcctggccgacctggccggtgaagctcggcgagctgaccccgcgcggcggcgagctgatcgcctacctcggccactactggcgccagcgcctcgtggccgacggcctcctcccgaagtgcggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacaacgccaacgtgaccgacgccatcctggagcgcgccggcggctccatcgccgacttcaccggccactaccagaccgccttccgcgagctggagcgcgtgctcaacttcccgcagtcgaacctctgcctcaagcgcgagaagcaggacgagtcctgctccctcacccaggccctcccgtccgagctgaaggtgtccgccgactgcgtgtccctcaccggcgccgtgtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgaactggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctctccctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggctgcacaaagtggagtagtcagtcatcgatcaggaaccagacaccagacttttattcatacagtgaagtgaagtgaagtgcagtgcagtgagttgctggtttttgtacaacttagtatgtatttgtatttgtaaaatacttctatcaataaaatttctaattcctaaaaccaaaatccag

SEQ ID NO: 91 - DNA, 10279 bp, Artificial Sequence
  Synthetic construct, pAG4821
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacctccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctggacgagctgaaggccgaggccaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccatcaatcccgggataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 92 - DNA, 10279 bp, Artificial Sequence
  Synthetic construct, pAG4822
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacctccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctggacgagctgaaggccgaggccaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccatcaatcccgggataaaattttagtgaagctaaagcggtgaaagattatagaatttgatgtgccagattaataaatcgattaactcctaaagttcaagccgagactacagacacatgagctacataaatgagccaaggactcgagcaaagacaaatcgacacagacattataattcaagtcattctagaagattcatgagaagagtatcatttatttaaatcaatgacttgatcaaataagacctaggagctactattgataatatatatcatgggtatctagatcaagcattatgaagaagagcctaagtagaaggccccatgggctcgaccacaaacccaaggactcgacaataaagtctaggagggatcccatagctaaaaggactctagaagtgtatgtatggtaaagattttatcgagacaagaaatacgataaagatcttaacagaatcggagtcatacttgtaaaaatagagttggactcgtgtacaacttggtcttcgacttagttcggtcatgaattcagtaaccgactagatatgtaccatggaacccctagggcatgaggctatgagccataggatcatcagatccaaacatacaccaacaaatccatcacacaccgaagatccatattaacaagggattagctactttacaatttcagagtaacaaatagagccaaactcatagcacaggggaacttcatatcacaaatggaggcattgaattgatataaaaagctaaagttctaaaaagtttgaagtgctgaaacttcaaagccgctaactagtgaagcaccgaagccttccggggagagaagacatacacgacacgttagggacgtaaaatgacgaaattatacaactacctctatatgtaacacttatgtaatagaaaagacagaatccatatgaagatgtataatggatcaaccatataaatagataaacaatatatctgctatggggattggcattcttgtatccctacgcctgtatatcccctgtttagagaacctccgaaggtatatgatgctgaagattattgttgtcttgtctttcatcatatatcgagtctttccctaggatattattattcgcaatgtgcattacatggttaatcgattgagagaacatgcatctcacctttagctgataaacgataatccatgttttacacttcgtagctactcatgagtttcgatatacaaatttgttttctggactacgtaccattccatcctcttaggagaggagaggaagtgtcctcgatttaattatgttgtcattttgtagttcttcacaaaatctcaacaggtaccaaacacattgtttccacaagacatattttagtcacaacaaatctatattattattaatcactaaaactatactgaggctcagatgcttttactagctcttgctagtatgtgatgtaggtctctttcgacatcattccatcaaaatcatatgattagcccataccaaacatttctataccattcagagaccagaatagtcttttctaatagaaaaaaggaaaatagagtgggccgacgacgacacaaattactgcgtggaccagaaaatagtgagacacggaagacaaaagaagtaaaagaggcaaggactacggcccacatgagattcggccccgccacctccggcaaccagcggccgatccaacggcagtgcatcctcaacggcgcgcgcgcgcgcgcgcgcgcacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctctccctcgccctcatctatcgcactcgtagtcgtagctcaagcatcagcggcaggagctctgggcagcgtgcgcacgtggggtacctagctcgctctgctagcctaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 93 - DNA, 3606 bp, Artificial Sequence
  Synthetic construct, pAG4871
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 94 - DNA, 2904 bp, Artificial Sequence
  Synthetic construct, pAG4868
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 95 - DNA, 3606 bp, Artificial Sequence
  Synthetic construct, pAG4872
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 96 - DNA, 2904 bp, Artificial Sequence
  Synthetic construct, pAG4869
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 97 - DNA, 3606 bp, Artificial Sequence
  Synthetic construct, pAG4870
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaaggccacgcagctcatgcaggacgtgaccccggacgcctggccgacctggccggtgaagctcggcgagctgaccccgcgcggcggcgagctgatcgcctacctcggccactactggcgccagcgcctcgtggccgacggcctcctcccgaagtgcggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacaacgccaacgtgaccgacgccatcctggagcgcgccggcggctccatcgccgacttcaccggccactaccagaccgccttccgcgagctggagcgcgtgctcaacttcccgcagtcgaacctctgcctcaagcgcgagaagcaggacgagtcctgctccctcacccaggccctcccgtccgagctgaaggtgtccgccgactgcgtgtccctcaccggcgccgtgtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgaactggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctctccctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 98 - DNA, 2904 bp, Artificial Sequence
  Synthetic construct, pAG4867
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaaggccacgcagctcatgcaggacgtgaccccggacgcctggccgacctggccggtgaagctcggcgagctgaccccgcgcggcggcgagctgatcgcctacctcggccactactggcgccagcgcctcgtggccgacggcctcctcccgaagtgcggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacaacgccaacgtgaccgacgccatcctggagcgcgccggcggctccatcgccgacttcaccggccactaccagaccgccttccgcgagctggagcgcgtgctcaacttcccgcagtcgaacctctgcctcaagcgcgagaagcaggacgagtcctgctccctcacccaggccctcccgtccgagctgaaggtgtccgccgactgcgtgtccctcaccggcgccgtgtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgaactggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctctccctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 99 - DNA, 21 bp, Artificial Sequence
  Synthetic construct, PCR primer 580
cgttgcatagggtttggtttg

SEQ ID NO: 100 - DNA, 18 bp, Artificial Sequence
  Synthetic construct, PCR primer 688
tcgacttggaggaggatg

SEQ ID NO: 101 - DNA, 19 bp, Artificial Sequence
  Synthetic construct, PCR primer 732
tggctaggacttgcagttt

SEQ ID NO: 102 - DNA, 24 bp, Artificial Sequence
  Synthetic construct, probe PB10
atctcgccacctcttccacatcac

SEQ ID NO: 103 - DNA, 24 bp, Artificial Sequence
  Synthetic construct, probe PB 11
tgtgatgatgtggtctggttgggc

SEQ ID NO: 104 - DNA, 22 bp, Artificial Sequence
  Synthetic construct, PCR primer 516
aacgtgactcccttaattctcc

SEQ ID NO: 105 - DNA, 20 bp, Artificial Sequence
  Synthetic construct, PCR primer  696
caccaaccttctggcatttg

SEQ ID NO: 106 - DNA, 22 bp, Artificial Sequence
  Synthetic construct, PCR primer 620
gattgccaagctgaaacatttg

SEQ ID NO: 107 - DNA, 19 bp, Artificial Sequence
  Synthetic construct, PCR primer 666
aatctgggccgctatttcc

SEQ ID NO: 108 - DNA, 24 bp, Artificial Sequence
  Synthetic construct, PCR primer 667
gccttgtcttagtcattgatttcc

SEQ ID NO: 109 - DNA, 22 bp, Artificial Sequence
  Synthetic construct, PCR primer 504
ctcatgatcaggttgtcgtttc

SEQ ID NO: 110 - DNA, 18 bp, Artificial Sequence
  Synthetic construct, PCR primer 747
aatctgggccgctatttc

SEQ ID NO: 111 - DNA, 17 bp, Artificial Sequence
  Synthetic construct, PCR primer 753
tttcacacgcctagtgg

SEQ ID NO: 112 - DNA, 30 bp, Artificial Sequence
  Synthetic construct, probe PB6
ctatcagtgcttccccaagttactagaacc

SEQ ID NO: 113 - DNA, 25 bp, Artificial Sequence
  ynthetic construct, probe PB8
tcagtgtttgaggaggatgtccacc

SEQ ID NO: 114 - DNA, 28 bp, Artificial Sequence
  Synthetic construct, probe PB9
cgccttgtcttagtcattgatttcctgc

SEQ ID NO: 115 - DNA, 23 bp, Artificial Sequence
  Synthetic construct, probe PB14
aatagggccatcgctcttagccc

SEQ ID NO: 116 - protein, 523 aa, Zea mays
  MISC_FEATURE (1)..(523): ACR23335 phytase
TAVPAEPASTLSGPSRPVTVAIGDRGHAVDLPDTDPRVQRRVTGWAPEQVAVALSASPTSAWVSWITGDYQMGGAVEPLDPGAVGSVVRYGLAADALDHEATGESLVYSQLYPFEGLQNYTSGIIHHVRLQGLEPGTRYVYRCGDPAIPDAMSGVHAFRTMPAVGPGSYPGRIAVVGDLGLTYNTTSTVDHLVRNRPDLVLLLGDVCYANLYLTNGTGADCYSCAFAKSTPIHETYQPRWDYWGRYMEPVTSSIPMMVVEGNHEIEQQIHNRTFAAYSSRFAFPSEESGSSSPFYYSFDAGGIHFVMLASYADYSRSGAQYKWLEADLEKVDRSVTPWLIAGWHAPWYTTYKAHYREAECMRVEMEELLYAYGVDVVFTGHVHAYERSNRVFNYTLDACGPVHISVGDGGNREKMATAHADEAGHCPDPASTPDPFMGGRLCAANFTSGPAAGRFCWDRQPEYSAYRESSFGHGVLEVRNDTHALWRWHRNQDLHAANVAADEVYIVREPDKCLAKTARLLAY

SEQ ID NO: 117 - protein, 301 aa, Zea mays
  MISC_FEATURE (1)..(301): AAB52233  phytase
SMAARITYERSGGTRSLVARDMDDYVVYGLNACLQNVRNCCVRLDAIDKLRAHYDALADAVAEPAANVEGLAAEASEYKAAMWQYCYNQRSASARAHSRAYSQALKLEGIDFAELVRRHQLRLGYGSKGEEFEDLDDTQKLEVYNSIIVESGRAGLPVRMFSSGRSAGGPKIAATTWAQAVSVFIMAAGNLAWDVFTTEHEVEAILKGSLNLLAGLGGFAVEAVVGAAVTKAVANVAAGVFACSLAGFVVGAIAGLIFVGVSGLLINLIIGSPRKVPDMSKLMFHTAVMPDGMALAYAVSH

SEQ ID NO: 118 - protein, 410 aa, Escherichia coli
  MISC_FEATURE (1)..(410): 1DKL    phytase
QSEPELKLESVVIVSRHGVRAPTKATQLMQDVTPDAWPTWPVKLGWLTPRGGELIAYLGHYQRQRLVADGLLAKKGCPQSGQVAIIADVDERTRKTGEAFAAGLAPDCAITVHTQADTSSPDPLFNPLKTGVCQLDNANVTDAILSRAGGSIADFTGHRQTAFRELERVLNFPQSNLCLKREKQDESCSLTQALPSELKVSADNVSLTGAVSLASMLTEIFLLQQAQGMPEPGWGRITDSHQWNTLLSLHNAQFYLLQRTPEVARSRATPLLDLIKTALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 119 - DNA, 20 bp, Artificial Sequence
  Synthetic construct, PCR primer 511
gcgcggtgtcatctatgtta

SEQ ID NO: 120 - DNA, 21 bp, Artificial Sequence
  Synthetic construct, PCR primer 779
gagcccgatcctaatccaatc

SEQ ID NO: 121 - DNA, 22 bp, Artificial Sequence
  Synthetic construct, PCR primer 784
gccttgtagccttcttgagtat

SEQ ID NO: 122 - DNA, 30 bp, Artificial Sequence
  Synthetic construct, probe PB15
ccgcaatgtgttattaagttgtctaagcgt

SEQ ID NO: 123 - DNA, 24 bp, Artificial Sequence
  Synthetic construct, probe PB16
ttgtaccatgagttgtgggtaggg

SEQ ID NO: 124 - DNA, 3004 bp, Zea mays
  promoter (1)..(3004): Maize globulin 1
cggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacg

SEQ ID NO: 125 - DNA, 38539 bp, Artificial Sequence
  Synthetic construct, PY15 locus
aagcttcaacgttaatccagccatctttgtcacaatggtttaatgggcaacgaccgttgtgtaatacaactagtttgggagtccaaataccggagagaattagaggtgctaaaatctttttcttattcaaaattcaataaggagaggaatttagcccctccgattttatggcttctaaactagccttaaatgtaaccgtacaagtgagccttcgaatccgttagatataatcaatcatatattaaatttaacacttaaatcctgctacaccggcttacgtagatttgtataaaaaacctaataagccacagttatatccaaactagttttgttggcttccggcggtatgtctcttttctttaccggcggtttataaaaagcggaagccactagtatgagatatgtagatatggactaaaaagatattaatgtaaggagatgtttggtttataagaactaatttttagtccatctattttattttattttagtttctaaattaacaaatacgaaaactaaaattttatttcctatttagcaatttaacgactaaaatgaaataaaataaaaaggactaattactaaatgtgggaactaaaattctattttaatttccatatttactaatttagatattaaaatgaaataaaatggagggaataaaaattagtccctagaaactaaacacccctaaaaattagtctctacaaatcaaacatcccctaaaaattaatcagtagaaaacaaacatctctaaaaattagtagttaaacttatgtaaaaaaaattagtcaaacttatgtaaaaaaccaaataaattaaaaattagaacaaagagagtagttaataaaccacatataacaatagaattgttataaatgctgcttctatttcctccgatcggaactgttcagccaccttccatcgatagcgaacttggatcagccaccttccatcgatagcgaacttggaggttcaaatattgtaaaaatacaagaagaaaggttttactctttatttctttgaaaggggtcgccgaagaaggttagttgatgtctcttatagcttttttgcacaggtgtaagagcaatcaaaccctatatatccgtttcaaatcaatccgaagcgtagagaagtctactgtttttttagcgtggtaaattgtagacccctctcgtggacatggtgacttcttttaacattttaagtatttttaagataatggacacatggataacatatatatactactctttaaattataacggacatgcactaactaaccttcttcggcgacccctttcaaagaaataaagagtatttataaagttgtgataattggatgttgattataaatctaatagtatcaattttatatttaaaatgtgaaaatcgaaaaggaataaattacaatggaccctggctattgtaagtttggaactctgtttccctacaaatcacactcgtgtcaagagcttctagcagcccagaaaaggtggactttgctctagtgtcagaaaagtccgagtgagctatatttcttggaaaatacaagtttgtttcagagcaaaaaacatttttcttttataaaagggccagcatgacaagatgatggctgactatcagcaaaagacacgaagtacaaaaaagaacaaaagatgtaaaaccctgcatccactgtattcatggacaacaaaaacagttcatcgatcattgttcaggtagaacacagtcgaaagaacgcaccccagagccagaatgcgaggaagcctattttcataataaaactgagagcgagaacacatttttttataagcgagcgacaacgttgaaccaagggcaagccatgcgcgtgtactccagcggtcgtcctcaccaacccaagtctcgagtcctgaatcctgatgcgcaccaaccacagccctaccaccgagcttcctgccccctccggccaacacgaaacttccgaaccactgtccactggctcccaagattagcgtatgtctgtgttctctgcaaacaaaaactcgtacattgccttggtcgtcttggaccagtcaccacagtccacaccaccagctcccctccctttccggaccctattgtgtttggaaaaatttcactctaaagctattcttatcacactatttttaatgttatcacgtcaataagattaaaatgcatttaagaacgaaatatgctctctcaatgaagagtttcatgacacaattttataggctaacatgtgattttaaatgttgcatgtaaataaccaatatgaatagataaaatagatggagataaataaattgttctcattggtggtttcatgcgcttttcagtaccttgaaaacgggttgacatagtttcgtagtgatgaaactagtttaatctatttcataataaatgtagtgttgtgtcatcaaaaatattatgtaattaatgtcataaataaattctctcataaaactctcatcgagaatggtctaagaaattcagctctattccacgaactctaccttttaataggtccaccatagagttgaaacaggaaaaattgtttagcttagcatttgactctagctccatgaatgatatagattttagaggaaatatctcttatattcttattttcaaggacccacatataggtgacctaattccattgtttctctatctttcatcgcactcacccagtcatctctctcgataaaacgatgcgaggcatgagatggcggcctccatcctcgcctccacgaggagatgcacatggcgagcccactggttgcccgtgagaagtggtcgtagcaagccgactgccgatgtggaggaggtggcacgctagggatatatgtccgccggtgtggaagaggaggtgcgctggggaagcgtgtcgacttggaggaggatgcacaatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccgtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtactatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcaggaattccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcggggacctaggtcacagctcgtccttctcgctcaggctgcaggccggaatcctggcctcgttcacgatctgggtgaagccggccaggctgcacatgccctgggcgttcctctcctcgcagccggccagggtcagcttcacctcgcccggcggggtgttcaggaacagcggggtcttgtccctcatctgctgcagggtctggaacaccaggctcacctgaatccactggctgttgtcgctcagcctcctccacctctcgaacaccagctcgccgcccggcggggtgttgtccggctggcccggcagggtccactgcagctcgagggcgccgcccaggttggccaggttggtgtcgtggccggcgatgaacagcacgctggtcggcagggtcacgccgtaggcctgcttctgcggcgggtgcggggtcagggcggtcttgatcaggtccagcagcggggtggccctgctcctggccacctccggggtcctctgcagcaggtcgaactgggcgttgtgcaggctcagcagggtgttccactggtggctgtcggtgatcctgccccagcccggctccggcatgccctgggcctgctgcagcaggaaaatctcggtcagcatgctggccaggctccaggcgccggtcaggctcacgttgtcggcgctcaccttcagctcgctcggcagggcctgggtcaggctggcgctctcgtcctgcttctccctcttcagggccaggttgctctgcgggaagttcagcaccctctccagctccctgaaggcggtctggtagtggccggtgaagtcggcgatgctgccgccggccctctccaggatggcgtcggtcacctgggccacgtccagctggcacacgccggtcttcagcgggttgaacagcgggtccgggctgctggtgtcggcctgggtgtgcacggtgatggcgcagtccggggccaggccggcggcgaaggcctcaccggtcttcctggtcctctcgtccacgtcggcgatgatggccacctggccgctctgcgggcagcccttcttcggcagcaggccgtcggccaccagcctctgcctccagtagtggcccaggtaggcgatcagctcgccgcccctcggggtcagctcgcccagcttcaccggccaggtgtagaacgcgtccggggtcacgtcctgcatcagctgggtgaacttggtcggggccctcacgccgtgcctgctcacgatcaccacgctctccagcttcagctccggctcgctctgggcagaggtggcgctggcagcaagagccagcagggccagggccacgagcagcacgcgcatggtttaggatcccgtgtagtgtctgtcactgtgatatgctcgggtgtgtgttgggttggctgtatgcagaactaaagcggaggtggcgcgcatttataccagcgccgggccctggtacgtggcgcggccgcgcggctacgtggaggaaggctgcgtggcagcagacacacgggtcgccacgtcccgccgtactctccttaccgtgcttatccgggctccggctcggtgcacgccagggtgtggccgcctctgagcagactttgtcgtgttccacagtggtgtcgtgttcctgggactccgatccgcggcgagcgaccgagcgtgtaaaagagttcctactaggtacgttcattgtatctggacgacaggcagcggacagtttgctgtaaatgaggggcagtttcccttttttttatagaaaaaacagagaattccgttgagctaattgtaattcaacaaataagctattagttggttttagcttagattaaagaagctaacgactaatagctaataattagttggtctattagttgactcattttaaatctctcggctatttttgatgcaaattactgtcactactggaatcgagcgctttgccgagtgtcaaagcctgaaaaacactccgtaaagactttgcctagtgtgacactcggcaaagagatctcgacgaacagtaaatcgacaacggcttctttgctgaatactttttatcggacacttgacaaagtctttgtcgagtgaactacattgaaactctatgattttatgtgtaggtcacttaggtttctacacatagtacgtcacaactttaccgaaacattatcaaatttttatcacaacctctatatatgatatcatgacatgtggacaagtttcattaatttctgactttatttgtgttttatacaatttttaaacaactggataacaagttcacggtcatgtttagtgagcatggtgcttgaagattctggtctgcttctgaattcggtcgtaacttgtgctagataacatgcatatcatttattttgcatgcacggtttttcatgtttcgagtgacttgcagttcatatgtgaattttccgaagaaattcaaataaacgaactaaatctaatagttatagaaaacatttttgtaattgtgccaaaatggtacatgtagatctacatagtgtaggaacataccacaaaaagtttggttggcaaaataaaaaaaaataaaatatactttatcgagtgtccaaggatggcactcggcaagcttgctctactgagtgtcggacgagggggcactcgacaaagataacgaccgtcagctttagacggcggctgacgaccctttgccgagcgctgccgttcgccgagtgtttggctctcggcaaagatttctttgtcgagtgtatttctgtgtcgagagtcctgctctcggtaaacgcggtcgttaccgagagcaggactttgccgagtgcggcacatggcaaagacttttttgccgagtgctggacaaaaagcactcgacaaagcgcctcacactcggcaaagagccggattccggtagtgtgtatggcgtacctacaaatttttattgaatgtggattgtatgtatagttctaaggtaaaagaaaggaaaaggggagtgtcactatgttacaaagtgttgtatccagtttctacttttagctcctgtctcgagcttaacttggtagcagatgtagttcatttcagtcttgaacatttccttgcaggccgccaccgttggcggtatgttttcgaatatccagttatttcgacatttccatatgcaccatgacatggttataataccttccattctccacggcattgttagtcttgctctaatatgtagcactgcaagcgttagatccaaagttcggggcggagtgattccaacagtgagccaacatctttgggcaaagttacaccgcaggaagtggtgagatatagtttcttccaactgtaagatgcagttttcgcatgtgtaggagtctaaacgcatgccctgacgtcttaggagagatctagtgttcaatctatctcttagcagcaaccataagaaaacctttcactttggttgacattttgtcttccaagtccaggagtatacaggatgggttcatgcctctcaagctgtaaaccctgaataatgccttaaagaagttgtagctagttctttattattttataggaataatagtagagatttgtacgactttagttattcaatattagagttatttttagtatgtgtcttattctggaggcatatctcttttaaatcaagaggatgataaattatgttacctaaattattcctattaggttatataataacgtgagttccttgcttattgagtttcatacatgaaaataactattttgagcaaagtataaaagaaaagtaaatacataaacataaaatatatttgcattcatgctggtattttggttgtgtattttgaaattgaactctaaatccaaactggtatttaaattcaaaatagaaatctaaaaatgtggatttgaaagattgagaattgaaacctaaggaagaatgtgattaagtcaattattctcccctaagtaaacaatatggggtagaataaaaaaattaaaagtaatagtaggggttaccttatcatataattttagtgtacaatttagaagctgaaattcaaaactcgaatttgaatttagtttgaaagcatgaaaattaaaagaaaggaaaatagaaaaggaagggaaataaaaagagaacctagtcggacttgagttatcaatttcagcccatctaccctacgcaccgcgctggcccactcaatcccctccccccgcccgtgtagtacactggcacaacatgcatactgaattatcgtttcaagcatattattacaaataaaaaataaaataatgcataaattattttatgtattatttgctccctacaacaaatttttttaaaagtactgaatttgtttccaaattcataccgggtacccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcggggacctaggtcacagctcgtccttctcgctcaggctgcaggccggaatcctggcctcgttcacgatctgggtgaagccggccaggctgcacatgccctgggcgttcctctcctcgcagccggccagggtcagcttcacctcgcccggcggggtgttcaggaacagcggggtcttgtccctcatctgctgcagggtctggaacaccaggctcacctgaatccactggctgttgtcgctcagcctcctccacctctcgaacaccagctcgccgcccggcggggtgttgtccggctggcccggcagggtccactgcagctcgagggcgccgcccaggttggccaggttggtgtcgtggccggcgatgaacagcacgctggtcggcagggtcacgccgtaggcctgcttctgcggcgggtgcggggtcagggcggtcttgatcaggtccagcagcggggtggccctgctcctggccacctccggggtcctctgcagcaggtcgaactgggcgttgtgcaggctcagcagggtgttccactggtggctgtcggtgatcctgccccagcccggctccggcatgccctgggcctgctgcagcaggaaaatctcggtcagcatgctggccaggctccaggcgccggtcaggctcacgttgtcggcgctcaccttcagctcgctcggcagggcctgggtcaggctggcgctctcgtcctgcttctccctcttcagggccaggttgctctgcgggaagttcagcaccctctccagctccctgaaggcggtctggtagtggccggtgaagtcggcgatgctgccgccggccctctccaggatggcgtcggtcacctgggccacgtccagctggcacacgccggtcttcagcgggttgaacagcgggtccgggctgctggtgtcggcctgggtgtgcacggtgatggcgcagtccggggccaggccggcggcgaaggcctcaccggtcttcctggtcctctcgtccacgtcggcgatgatggccacctggccgctctgcgggcagcccttcttcggcagcaggccgtcggccaccagcctctgcctccagtagtggcccaggtaggcgatcagctcgccgcccctcggggtcagctcgcccagcttcaccggccaggtgtagaacgcgtccggggtcacgtcctgcatcagctgggtgaacttggtcggggccctcacgccgtgcctgctcacgatcaccacgctctccagcttcagctccggctcgctctgggcagaggtggcgctggcagcaagagccagcagggccagggccacgagcagcacgcgcatggtttaggatccggtgtcgatcgggttcttctgcgctctggagtagataaagctaatggtctgaagacccagtggtggtgatggagaagtgcacaggcatgcgagcgttatttatagctttgattaattaacacaatttcttgtgttcttatgccaccgagacggctgtaggcagcttcatggtttcttgccaaatgtatatgactcgtcactctctttacgtagcacgtcgatggttcatctggaatcattctgtacttctgcgtggctcagttttgttgccttctacaggttgttgatctacgtaaaacgaattagatttagcttgacatatggctttttttttgttgtaaatttactttacacgtcaaggatttttgtcctgttccggcctattttatttttcatgaaacgatctttgtaatgcaatatgagttgtttgtaatgtcttgtgagctgtaagcatgtatatcagatgagtatgatctcggcatgactcaccgtgtttctttgcacacagagaggatttgtttgattgtttcttacccaatacccttgacgtgcaattttggttgatgttctgtgagttgttaaggatacaacgaattcttggagctttacatgccaatgcatggttgtttcgtgttcctcaacatttaaggacttattcggttgcacctggatcgaaggggattgggagaaatcgattaaatctccttctatttaattttgactaggaagagatttaatcgtttccaacccctttcgatccagacgtaagcgaacaagttatttatttggatacctcttattcatcttaatacacacatggtattaagttgccactagtcatatgcctgtgcattgctacggtttatattatatatatatatatatatatatatatatatatatatatatatgataaattttgttttaataaaacatatgttttctattgattaggttgtgtgaatatgagccaacaaccaaggtccagaacacttatacataatttcaccttattttgtacataaactctcttattatagtagtaagagaagagattataagagtgcgggttgattataaagaaatgtaggagttttttaataatattgacacgagacgatcgttgaactggtgctttaatatagtaaagataaagattggtgttggggacttgttctcaaatgctatgaattaagaacaaggcaacataaaatgttaaatatcaaaatccttcgtccttcgaagcattattttcctttggatataatggatttcggacgaaggttatgaaggtcataccttcataatcataatcaaatgaaaaagtaaagaagattcacacataaaataatatgattactttggtacccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcggggacctaggtcacagctcgtccttctcgctcaggctgcaggccggaatcctggcctcgttcacgatctgggtgaagccggccaggctgcacatgccctgggcgttcctctcctcgcagccggccagggtcagcttcacctcgcccggcggggtgttcaggaacagcggggtcttgtccctcatctgctgcagggtctggaacaccaggctcacctgaatccactggctgttgtcgctcagcctcctccacctctcgaacaccagctcgccgcccggcggggtgttgtccggctggcccggcagggtccactgcagctcgagggcgccgcccaggttggccaggttggtgtcgtggccggcgatgaacagcacgctggtcggcagggtcacgccgtaggcctgcttctgcggcgggtgcggggtcagggcggtcttgatcaggtccagcagcggggtggccctgctcctggccacctccggggtcctctgcagcaggtcgaactgggcgttgtgcaggctcagcagggtgttccactggtggctgtcggtgatcctgccccagcccggctccggcatgccctgggcctgctgcagcaggaaaatctcggtcagcatgctggccaggctccaggcgccggtcaggctcacgttgtcggcgctcaccttcagctcgctcggcagggcctgggtcaggctggcgctctcgtcctgcttctccctcttcagggccaggttgctctgcgggaagttcagcaccctctccagctccctgaaggcggtctggtagtggccggtgaagtcggcgatgctgccgccggccctctccaggatggcgtcggtcacctgggccacgtccagctggcacacgccggtcttcagcgggttgaacagcgggtccgggctgctggtgtcggcctgggtgtgcacggtgatggcgcagtccggggccaggccggcggcgaaggcctcaccggtcttcctggtcctctcgtccacgtcggcgatgatggccacctggccgctctgcgggcagcccttcttcggcagcaggccgtcggccaccagcctctgcctccagtagtggcccaggtaggcgatcagctcgccgcccctcggggtcagctcgcccagcttcaccggccaggtgtagaacgcgtccggggtcacgtcctgcatcagctgggtgaacttggtcggggccctcacgccgtgcctgctcacgatcaccacgctctccagcttcagctccggctcgctctgggcagaggtggcgctggcagcaagagccagcagggccagggccacgagcagcacgcgcatggtttaggatccgttgttgtaggactaatgaactgaatgctttttgtgagaaacaatgagaaatcatcgtgcatttatagtgagataaaggctcttgcatctaaatgttaagatagagtttgttaatgtccagacatgaagtgactcatgatatatgaagtgtggtacacgaaaggtggatgaataatgatggacatacagatatgtataattgacgcagcattgtgttgttctttctctctttcttttgcaatatgacatggataatgtaaagccctcctctttttgacacgaaaggcaaatgaatttttgtgagtcatgccttgtcttataagctctcctctttttgcaatatgacatatagctctggagttttatgtacacatcattttgctttatcttgcttgagtctgtgatttgtcatgtgtcacgcctaatactcatcaaacgtgacttatgggtttatgttctaacatttagcggagaattaagggagtcacgttatgacccccgccgatgacgcgggacaagccgttttacgtttggaactgacagaaccgcaacgttgaaggagccactcagcctaagcggccgcattggacttaattaagtgaggccggccaagcgtcgatttaaatgtaccacatggcgcgccaactatcatgcgatcgcttcatgtctaactcgagttactggtacgtaccaaatccatggaatcaaggtacctccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacccggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatttgtttcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcctaagcggccgcattggacttaattaagtgaggccggccaagcgtcgatttaaatgtaccacatggcgcgccaactatcatgcgatcgcttcatgtctaactcgagttactggtacgtaccaaatccatggaatcaaggtacctccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggatacacgactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcctaagcggccgcattggacttaattaagtgaggccggccaagcgtcgatttaaatgtaccacatggcgcgccaactatcatgcgatcgcttcatgtctaactcgagttactggtacgtaccaaatccatggaatcaaggtacctccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggcgatggttctaggcggtgacgtggaagaggtggcgagatcctaggcgatgggggcgaaaactgcaaggtcctaggccatggtagcggtgggaggcgaggtgaagcgcaatggacatagcattctttttgtgattcggtatgggagggagtgtgtaaatagtagcaatacgggtaattaccctacaactccaagaggaggtacaaaataatgattcctggggcaccccttggagctccacaaaaaactgaagttgaggctaggtcctcatttttttatggcgccagagttgaaggtggtttcgttgatgcgatatattaaaaaattacattaccgcctaacatatgaaggattgactatacaacgtcctcaactataaacttaatattatagctacatctaaaattatttaaatggctctctagatggtcttgtaggaccgtttggacaccatatccaattacattgactcatgcatttatacttgcacacatgcacatcggttgtctccatcttcctactatttaaaggtctaccgaacaaatatccgtcaagcaacccaggaggcgatgttgtcgagcaacctactcatcgagcaacccaataaggcgaggctgccgagcgatctgcctgccaagtaacccaccaaggcggggttgccgaacaacctgcccgccgagcaacccagccaaccaaccggtcctccgagcaacctagcaaaacgacagtcgactcataggaagagtcggcctggtacaatcaagccacgacaacatgacgagacatcatcgagccagatccagaccgtgaaaacggcactgagggatctttgtcaaacatgacgacggatacgtatccctgctgacacatgtgaccggacgaccccgaccgtagaaacctcagcatcggggtttctacagtgacccatacaccggaagggatgagacaatatgtcgtatcaagcgtgcatctacgtatgatgaaagatgacgctgctcggaggatgacagaagatgaagttgtatgaacacatccctaaagcactcattgagctgactcaacagaaactaccaggcactgccacgtctaaatcagagtagctataggaaggcggacaggacgtgacgccataccaggggtacggcgcacgcctcgactaacgactctacaagggctacgaggcccaaaagcgtgacccaacagacgagaccaccggggctacgaggcctagaagcaggataccaaactctaccctagtagaatactagtcctcattgtaacgtctatccttggactataaaagggcaatacaaccctcatccaaacatgatcccgtatctctacaacttcacacaagcactcagctgtaacacgttccatcattgtattgtctacccttgggctataaaagggcaagacaacccccatccaaacatgatcctgtatactcagctgtaacacgttccaagcaatatcacaatcagcactgcactggactagggctccggtctgaactagtataaccagcccgcctcagatccacacccatagctcaccattcgaagtgagtccgtgctaacactcccgccgaatacaaatcttattgtccactggttccagaaaccacgacacttatcttaaaaacttatgtttcaacttaatacatattgaagatagtaaaggtgcaatgcaaatgatagcaacaaatatagaatgattggtaaaattatttattagaactaaatagaacatgtatggtatgtacatgggtagagttatgaaataaagagaataaatataattaattttgagtagttatgcatattttaaaaaaccatatagatttatgtgacgcaagattccagacagtgttgaaatgcctttatttgacaatgtttatagagtgataaacatggcaaatagaccatgagatggttatatgagcaagatagtgcttcccgcgcatgtgttcgttactctcccatgtgttccggtccttcgacagcaaacacttaaagcatggacttaacaaagtgcagtaatgcggtctcattatagcacaccccccacataaaaaaacaatatccgcagctagaagacaacacacagcctaagcacgttcagccgaggccaagcaatccgcatccgccccagcccccagcagccctcaccaaccatcattgtgtgtagttgttgggagaggggagggccttgacgaatgacgaggaccaaccacagccccgccgctacagagctacccgccccaacggcgaccaggaagtttccacgccgctggccttgtgacatgcgcacattgtcttggtcgtctttggacaagtctcgactctccacaccaccagcccggtcccttctcagaagcattagctatttaaacctcgccactcctgctggttctctccaggaagagcagcactagatctctctcccctacagcttcccagcaagccagttgcatacatttcactgctgttatctttctcagcttgatcagtgctttagttctctctagttgcaatggcttgcgatttcccgtgcatggcgacgccccgcgccgacccgcttaactgggggaaggcggcggaggagctgatgggcagccacctggacgaggtcaagcggatggtggccgagtaccgccaaccctcggtgaagatcgagggcgccagcctcagcatcgcgcaggtggccgctgtggccaccggcgctggcgaggctcgggtcgagctggacgagtccgcccgtagccgggtcaaggcaagcagcgactgggtcatgagcagcatgatgaacggcaccgacagctacggcgtcaccaccggcttcggcgccacgttgcacaggaggaccaaggagggcggcgctctccagagggagctcatcaggttcctcaacgctggcgccttcggcaccggcacggacggccacgtcctcccggccgaggcgacgcgcgcggccatgctcgtccgcatcaacaccctcctccaggggtactccgggatccgcttcgagatcctcgaggcgatcgtcaagctgctcaacgccaacgtcacgccgtgcctgccgctccgcggcacggtcaccgcgtccggcgacctcgtgccgctctcctacattgccggcctcgtcaccgggcgtgagaactctgttgccctcgccccagacggcagcaaggtgaacgccgccgaggcattcaagattgccggaatccagggcggcttcttcgagctgcagcccaaggagggtcttgcgatggtgaacggcacggccgtgggctctggcctcgcctccactgtgctcttcgaggctaacatccttgccatcctcgccgaggtcctgtccgccgtgttctgcgaagtcatgaacggcaagccggagtacaccgaccacctgacccacaagctcaagcaccacccgggacagatcgaggctgctgccatcatggagcacatcttggagggcagctcctacatgaagctt

SEQ ID NO: 126 - DNA, 231 bp, Artificial Sequence
  Synthetic construct, PY15_688+580
tcgacttggaggaggatgcacaatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaac

SEQ ID NO: 127 - DNA, 122 bp, Artificial Sequence
  Synthetic construct, PY15_688+732
tggctaggacttgcagttttcgcccccatcgccgaggatctcgccacctcttccacatcaccgcctagaacctcgctatcggcggggcgactttccccattgtgcatcctcctccaagtcga

SEQ ID NO: 128 - DNA, 186 bp, Artificial Sequence
  Synthetic construct, PY203-3293_696+516
caccaaccttctggcatttgagaattcatctcatccaaaaacttctataatatatcattcagtgtcaggcctctcccttggctagggctaggagaggttctagtaacttggggaagcactgatagttaaaactgaaggcgggaaacgacaacctgatcatgagcggagaattaagggagtcacgtt

SEQ ID NO: 129 - DNA, 278 bp, Artificial Sequence
  Synthetic construct, PY203-3293_696+620
caccaaccttctggcatttgagaattcatctcatccaaaaacttctataatatatcattcagtgtcaggcctctcccttggctagggctaggagaggttctagtaacttggggggctaagagcgatggctctattatagtggacctcgaagtctatctttcgagcagaaatttttgaatgcgtattagtggcagatggatgaatgtctggcctttcccaaacgttaacaagcatatgcattttcaaatattactttcaaatgtttcagcttggcaatc

SEQ ID NO: 130 - DNA, 163 bp, Artificial Sequence
  Synthetic construct, PY203-3293_696+504
caccaaccttctggcatttgagaattcatctcatccaaaaacttctataatatatcattcagtgtcaggcctctcccttggctagggctaggagaggttctagtaacttggggaagcactgatagttaaaactgaaggcgggaaacgacaacctgatcatgag

SEQ ID NO: 131 - DNA, 136 bp, Artificial Sequence
  Synthetic construct, PY203-3507_666+516
aatctgggccgctatttccctgacctcacaaccagccgcaaaggcgcggtggacatcctcctcaaacactgatagtttaaactgaaggcgggaaacgacaacctgatcatgagcggagaattaagggagtcacgtt

SEQ ID NO: 132 - DNA, 104 bp, Artificial Sequence
  Synthetic construct, PY203-3507_666+667
aatctgggccgctatttccctgacctcacaaccagccgcaaaggcgcggtggacatcctcctcagaacgatgttccagcaggaaatcaatgactaagacaaggc

SEQ ID NO: 133 - DNA, 113 bp, Artificial Sequence
  Synthetic construct, PY203-3507_747+504
aatctgggccgctatttccctgacctcacaaccagccgcaaaggcgcggtggacatcctcctcaaacactgatagtttaaactgaaggcgggaaacgacaacctgatcatgag

SEQ ID NO: 134 - DNA, 124 bp, Artificial Sequence
  Synthetic construct, PY203-3507_747+753
aatctgggccgctatttccctgacctcacaaccagccgcaaaggcgcggtggacatcctcctcagaacgatgttccagcaggaaatcaatgactaagacaaggcgagccactaggcgtgtgaaa

SEQ ID NO: 135 - DNA, 377 bp, Artificial Sequence
  Synthetic construct, PY53_784+511
gccttgtagccttcttgagtataagtttggtattcggtttttaccgaaaaaaccaaagtaaaaaaccgaaaccgaacttatcggtttttcattttctagaaaaccgatcggcttctaatatttgaaaccccgaagttttttaaaaccaaagaaccgaaccgaagtttcaaaaaaccgaatgccaaccctattgaagagcatcatttatgggtgaggttaggttggtaattttgtaccatgagttgtgggtagggatatattgtggtgtaaacaaattgacgcttagacaacttaataacacattgcggacgtttttaatgtactgaattaattcgagctcgccaattcccgatctagtaacatagatgacaccgcgc

SEQ ID NO: 136 - DNA, 158 bp, Artificial Sequence
  Synthetic construct, PY53_511+779
gcgcggtgtcatctatgttactagatcgggaattggcgagctcgaattaattcagtacattaaaaacgtccgcaatgtgttattaagttgtctaagcgtcaatttgtttacaccacaatatatgaatttatgaatcggattggattaggatcgggctc

SEQ ID NO: 137 - DNA, 319 bp, Artificial Sequence
  Synthetic construct, PY53_784+779
gccttgtagccttcttgagtataagtttggtattcggtttttaccgaaaaaaccaaagtaaaaaaccgaaaccgaacttatcggtttttcattttctagaaaaccgatcggcttctaatatttgaaaccccgaagttttttaaaaccaaagaaccgaaccgaagtttcaaaaaaccgaatgccaaccctattgaagagcatcatttatgggtgaggttaggttggtaattttgtaccatgagttgtgggtaggggtggtaatgggctctaaatttttcactataaaatttatgaatcggattggattaggatcgggctc

SEQ ID NO: 138 - DNA, 5189 bp, Artificial Sequence
  Synthetic construct, pAG4904
cggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgagggtgttgctcgttgccctcgctctcctggctctcgctgcgagcgccaccagcgccgggatgactgatctgctgatgctgaccgacaagtcgcagctgcaggcgctagcgatgctgctgcggaacaacgaggagctcatgatgagccaagcgatcaagtcggagacggagcgcgttgagtacctcaagacggtgagcgactgctacacgcggacaatgaagctccttgacgactccatggcggccaggatcacgtacgagcgttcgggcggaacgaggagcctcgtcgcgcgggacatggacgactacgtcgtctacggcctcaacgcgtgcttgcagaacgtccgcaactgctgcgtgcgtctggacgccatcgacaagctgcgggcgcactacgacgccctcgccgacgccgtcgccgaaccggccgccaacgtcgagggcctcgccgcggaggcgtccgagtacaaggccgccatgtggcagtactgctacaaccagcggagcgcctccgcgcgggcgcactcccgcgcctactcccaggcgctcaagctggagggcatcgacttcgccgagcttgtgcggaggcaccagctccggctcgggtacggcagcaagggcgaggagttcgaggacctggacgacacccagaagctggaggtgtacaacagcatcatcgtcgagtcggggcgggcggggctaccggtgcggatgttctcgtcgggccgctctgccggtggccctaagattgcagccacgacgtgggcgcaggcggtgagcgtcttcatcatggcggcgggcaacctggcgtgggacgtgttcaccacggagcacgaggtggaggccatcctcaagggcagcctcaacctcctggcggggctagggggcttcgccgtggaggccgtcgtcggcgcggctgtcaccaaggcggtcgcaaacgtcggcgccggcgtctttgcttgctctctcgcgggcttcgtcgtgggcgccatagccgggctgatcttcatcggcgtcagcggcctcctcattaacctcatcatcggctccccgaggaaggtgcctgacatgagcaagctcatgttccacaccgccgtcatgcccgatggaatggcccttgcgtatgcggtatctcatagcgagaaggacgagctgtaacctaggggccgccgcgctcgccaaaacgagcaagaagcaacaagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcggatacgatgctgtatgctactgaggcaagtcccataaataaataatgacacgtgcgtgttctataatctcttcgcttcttcagtgtccccttgcggagtttggcatccattgatgccgttacactgagaacataacggacacagtagacgaaccacttgagttcttgtatgaaattctgacccttttttttgaaggatcaggagggggaaacccctactggcctggtccttttacaatcaataaaaagaaaagaaaaagaaagaaaaaggaagagctatttctatatttgccacaaatttagccagttcgggattgaggtgtcgaattctccccgtgctctgtgaatgattagtcgcaattctctactaaattcctgagtacagcggagcacggagggatctctgtttgaaaacaaccactcgtttcggcttttccagatgctccaagtcataagaatagtgatctccatagagaagggaacgttgagctggtgtttgaggttcacagatgcctcttcagggttggaaattctgggtggggtaatgccaattgagttccagcaggctttcgcgaagttgcatctgaggaaaagatgataaagggtctcctctctttgccaaaggcagttttcgcaagagtaggaatctagctccatgtttctccttctcaacatatttctggtgtttagcctgttcttaagccacagccaatagaagactctatgcttaggctgacacttacttttccaaactagtttgtagataggatgagtttgcatctggcccatgaaagatctgtaagctttttgggacgacccggggaat

SEQ ID NO: 139 - DNA, 5192 bp, Artificial Sequence
  Synthetic construct, pAG4905
cggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgagggtgttgctcgttgccctcgctctcctggctctcgctgcgagcgccaccagcgccgggatgactgatctgctgatgctgaccgacaagtcgcagctgcaggcgctggcgatgctgctgcggaacaacgaggagctcatgatgagccaggcgatcaagtcggagacggagcgcattgagtacctcaagacggtgagcgactgctacacgcggacgatgaagctcctcgacgattccatggcggccaggaccacgtacgagcgttcgggcggaacgaggagcctcgtcgcgcgggacatggacgactacgtcgtctacggcctcaacgcgtgcttgcagaacgtccgcaactgctgcgtgcgcctggacgccatcgacaagctgcgggcgcactacgacgccctcgccgacgccgtcgccgacccggccgccaacgtcgagggcctcgccgcggaggcgtccgagtacaaggccgccatgtggcagtactgctacaaccagcggagcgcctccgcgcgggcgcactcccgcgcctactcccaggcgctcaagctggagggcatcgacttcgccgagctggtgcggaggcaccagctccggctcgggtacggcagcaagggcgaggagttcgaggacctggacgacacccagaagctggaggtgtacaaacagcatcatcgtcgagtcggggcggggcgggggctaccggtgcggatgttctcgtcgggccgctctgccggtggccctaagattgcagccacgacgtgggcggaggcggtgagcgtcttcatcatggcggcgggcaacctggcgtgggacgtgttcaccacggagcacgaggtggaggccatcctcaagggcagcctcaacctcctggcggggctagggggcttcgccgtggaggccgtcgtcggcgcggctgtcaccaaggcggtcgcaaacgtcggcgccggcgtctttgcttgctctctcgccggcttcgtcgtgggcgccatcgccgggctgatcttcgtcggcgtcagcggcctcctcattaacctcatcatcggctccccaaggaaggtgcctgacatgagcaagctcatgttccacaccgccgtcatgcccgatggaatggcccttgcgtatgcggtatctcatagcgagaaggacgagctgtaacctaggggccgccgcgctcgccaaaacgagcaagaagcaacaagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcggatacgatgctgtatgctactgaggcaagtcccataaataaataatgacacgtgcgtgttctataatctcttcgcttcttcagtgtccccttgcggagtttggcatccattgatgccgttacactgagaacataacggacacagtagacgaaccacttgagttcttgtatgaaattctgacccttttttttgaaggatcaggagggggaaacccctactggcctggtccttttacaatcaataaaaagaaaagaaaaagaaagaaaaaggaagagctatttctatatttgccacaaatttagccagttcgggattgaggtgtcgaattctccccgtgctctgtgaatgattagtcgcaattctctactaaattcctgagtacagcggagcacggagggatctctgtttgaaaacaaccactcgtttcggcttttccagatgctccaagtcataagaatagtgatctccatagagaagggaacgttgagctggtgtttgaggttcacagatgcctcttcagggttggaaattctgggtggggtaatgccaattgagttccagcaggctttcgcgaagttgcatctgaggaaaagatgataaagggtctcctctctttgccaaaggcagttttcgcaagagtaggaatctagctccatgtttctccttctcaacatatttctggtgtttagcctgttcttaagccacagccaatagaagactctatgcttaggctgacacttacttttccaaactagtttgtagataggatgagtttgcatctggcccatgaaagatctgtaagctttttgggacgacccggggaat

SEQ ID NO: 140 - DNA, 5684 bp, Artificial Sequence
  Synthetic construct, pAG4906
cggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgagggtgttgctcgttgccctcgctctcctggctctcgctgcgagcgccaccagcaccgcggttcccgccgagccggcgtcgacgctgtccgggccgtcgcggccggtgacggtggcgatcggagacaggggccacgcggtggacctgccggacacggacccgcgggtgcagcgccgcgtcacgggctgggcgcccgagcagatcgccgtcgcgctctccgcctcgcccacctccgcctgggtctcctggatcacaggggactaccagatgggcggcgccgtggagccgctggaccccggcgcggtgggcagcgtcgtgcggtacggcctcgccgccgacgccctcgaccacgaggccaccggggagtcgctcgtgtacagccagctgtacccgttcgagggcctccagaactacacctccggcatcatccaccacgtccgcctccagggcctggagcctgggaccaggtacttgtaccggtgcggcgacccggccatcccggacgccatgagcgacgtgcacgcgttccgcacgatgccggccgtcgggccggggagctacccagggcggatcgccgtggtcggggacctcgggctcacctacaacaccacctcgacggtggaccacttggtgcgcaaccgccccgacctggtgctcctcctcggcgacgtctgctacgccaacctgtacctgaccaacggcaccggggcggactgctactcctgcgccttcgccaagtccacgcccatccacgagacgtaccagccgcgctgggattactggggaaggtacatggagcccgtgacgtcgagcatcccgatgatggtggtggagggcaaccatgagatcgagcagcagatccacaacaggacgttcgcggcctacagctcgcggttcgcgttcccgtcggaggagagcgggtcctcctcgccgttctactactcgttcgacgccggcggcatccacttcgtcatgcttgcgtcctacgccgactacagcagatcaggtgcgcagtacaagtggctggaggcggacctggagaaggtggacaggtcggtgacgccatggctgatcgcgggctggcacgcgccctggtacaccacctacaaggctcactacagggaagccgagtgcatgagggtggagatggaggagctcctctacgcctacggtgtcgacgtcgtcttcaccggccacgtgcacgcgtacgagcggtcgaaccgggtgttcaactacacgctggacgcgtgcggccccgtgcacatctcggtgggcgacggcggcaaccgcgagaagatggcgacggcgcacgcggacgaggcgggccactgcccggacccggcgtcgacgccggaccccttcatggggggccgcctctgcgccgccaacttcacgtcgggccccgccgcgggccgcttctgctgggaccgccagccggagtacagcgcgtacagggagagcagcttcgggcacggcgtcctggaggtcaggaacgacacgcacgcgctctggcggtggcaccgcaaccaggacctccatgccgccgccgccgccaacgtcgccgccgacgaggtctacatcgtcagggagcccgacaagtgcctcgccaagacggccagattgttggcctatagcgagaaggacgagctgtgacctaggggccgccgcgctcgccaaaacgagcaagaagcaacaagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcggatacgatgctgtatgctactgaggcaagtcccataaataaataatgacacgtgcgtgttctataatctcttcgcttcttcagtgtccccttgcggagtttggcatccattgatgccgttacactgagaacataacggacacagtagacgaaccacttgagttcttgtatgaaattctgacccttttttttgaaggatcaggagggggaaacccctactggcctggtccttttacaatcaataaaaagaaaagaaaaagaaagaaaaaggaagagctatttctatatttgccacaaatttagccagttcgggattgaggtgtcgaattctccccgtgctctgtgaatgattagtcgcaattctctactaaattcctgagtacagcggagcacggagggatctctgtttgaaaacaaccactcgtttcggcttttccagatgctccaagtcataagaatagtgatctccatagagaagggaacgttgagctggtgtttgaggttcacagatgcctcttcagggttggaaattctgggtggggtaatgccaattgagttccagcaggctttcgcgaagttgcatctgaggaaaagatgataaagggtctcctctctttgccaaaggcagttttcgcaagagtaggaatctagctccatgtttctccttctcaacatatttctggtgtttagcctgttcttaagccacagccaatagaagactctatgcttaggctgacacttacttttccaaactagtttgtagataggatgagtttgcatctggcccatgaaagatctgtaagctttttgggacgacccggggaat

SEQ ID NO: 141 - DNA, 5669 bp, Artificial Sequence
  Synthetic construct, pAG4907
cggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgagggtgttgctcgttgccctcgctctcctggctctcgctgcgagcgccaccagcgagccggcgtcgacgctgtccgggccgtcgcggccggtgacggtggcgatcggagacaggggccacgcggtggacctgccggacacggacccgcgggtgcagcgccgcgtcacgggctgggcgcccgagcagatcgccgtcgcgctctccgcctcgcccacctccgcctgggtctcctggatcacaggggactaccagatgggcggcgccgtggagccgctggaccccggcgcggtgggcagcgtcgtgcggtacggcctcgccgccgacgccctcgaccacgaggccaccggggagtcgctcgtgtacagccagctgtacccgttcgagggcctccagaactacacctccggcatcatccaccacgtccgcctccagggcctggagcctgggaccaggtacttgtaccggtgcggcgacccggccatcccggacgccatgagcgacgtgcacgcgttccgcacgatgccggccgtcgggccggggagctacccggggcggatcgccgtggtcggggacctcgggctcacctacaacaccacctcgacggtggaccacttggtgcgcaaccgccccgacctggtgctcctcctcggcgacgtctgctacgccaacctgtacctgaccaacggcaccggggcggactgctactcctgcgccttcgccaagtccacgcccatccacgagacgtaccagccgcgctgggattactggggaaggtacatggagcccgtgacgtcgagcatcccgatgatggtggtggagggcaaccatgagatcgagcagcagatccacaacaggacgttcgcggcctacagctcgcggttcgcgttcccgtcggaggagagcgggtcctcctcgccgttctactactcgttcgacgccggcggcatccacttcgtcatgcttgcgtcctacgccgactacagcagatcaggtgcgcagtacaagtggctggaggcggacctggagaaggtggacaggtcggtgacgccatggctgatcgcgggctggcacgcgccctggtacaccacctacaaggctcactacagggaagccgagtgcatgagggtggagatggaggagctcctctacgcctacggtgtcgacgtcgtcttcaccggccacgtgcacgcgtacgagcggtcgaaccgggtgttcaactacacgctggacgcgtgcggccccgtgcacatctcggtgggcgacggcggcaaccgcgagaagatggcgacggcgcacgcggacgaggccggccactgcccggacccggcgtcgacgccggaccccttcatggggggccgcctctgcgccgccaacttcacgtcgggccccgccgcgggccgcttctgctgggaccgccagccggagtacagcgcgtacagggagagcagcttcgggcacggcgtcctggaggtcaggaacgacacgcacgcgctctggcggtggcaccgcaaccaggacctccatgccgccgccgccgccaacgtcgccgccgacgaggtctacatcgtcagggagcccgacaagtgcctcgccaagacggccagattgttggcctatagcgagaaggacgagctgtgacctaggggccgccgcgctcgccaaaacgagcaagaagcaacaagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcggatacgatgctgtatgctactgaggcaagtcccataaataaataatgacacgtgcgtgttctataatctcttcgcttcttcagtgtccccttgcggagtttggcatccattgatgccgttacactgagaacataacggacacagtagacgaaccacttgagttcttgtatgaaattctgacccttttttttgaaggatcaggagggggaaacccctactggcctggtccttttacaatcaataaaaagaaaagaaaaagaaagaaaaaggaagagctatttctatatttgccacaaatttagccagttcgggattgaggtgtcgaattctccccgtgctctgtgaatgattagtcgcaattctctactaaattcctgagtacagcggagcacggagggatctctgtttgaaaacaaccactcgtttcggcttttccagatgctccaagtcataagaatagtgatctccatagagaagggaacgttgagctggtgtttgaggttcacagatgcctcttcagggttggaaattctgggtggggtaatgccaattgagttccagcaggctttcgcgaagttgcatctgaggaaaagatgataaagggtctcctctctttgccaaaggcagttttcgcaagagtaggaatctagctccatgtttctccttctcaacatatttctggtgtttagcctgttcttaagccacagccaatagaagactctatgcttaggctgacacttacttttccaaactagtttgtagataggatgagtttgcatctggcccatgaaagatctgtaagctttttgggacgacccggggaat

SEQ ID NO: 142 - DNA, 4609 bp, Artificial Sequence
  Synthetic construct, pAG4260
cggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaaggccacgcagctcatgcaggacgtgaccccggacgcctggccgacctggccggtgaagctcggcgagctgaccccgcgcggcggcgagctgatcgcctacctcggccactactggcgccagcgcctcgtggccgacggcctcctcccgaagtgcggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacaacgccaacgtgaccgacgccatcctggagcgcgccggcggctccatcgccgacttcaccggccactaccagaccgccttccgcgagctggagcgcgtgctcaacttcccgcagtcgaacctctgcctcaagcgcgagaagcaggacgagtcctgctccctcacccaggccctcccgtccgagctgaaggtgtccgccgactgcgtgtccctcaccggcgccgtgtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgaactggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctctccctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 143 - DNA, 4609 bp, Artificial Sequence
  Synthetic construct, pAG4264
cggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 144 - DNA, 4609 bp, Artificial Sequence
  Synthetic construct, pAG4266
cggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 145 - DNA, 7583 bp, Artificial Sequence
  Synthetic construct, pAG4279
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacccggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 146 - DNA, 8297 bp, Artificial Sequence
  Synthetic construct, pAG4811
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctggacgagctgaaggccgaggccaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacccggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 147 - DNA, 7583 bp, Artificial Sequence
  Synthetic construct, pAG4280
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacccggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 148 - DNA, 8297 bp, Artificial Sequence
  Synthetic construct, pAG4812
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctggacgagctgaaggccgaggccaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacccggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaaggccacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggcgaggccttcgccgccggcctggccccggactgcgccatcaccgtgcacacccaggccgacaccagcagcccggacccgctgttcaacccgctgaagaccggcgtgtgccagctggacaacgcccaggtgaccgacgccatcctggagagggccggcggcagcatcgccgacttcaccggccactaccagaccgccttcagggagctggagagggtgctgaacttcccgcagagcaacctgtgcctgaagagggagaagcaggacgagagctgcagcctgacccaggccctgccgagcgagctgaaggtgagcgccgacaacgtgagcctgaccggcgccgtgagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgtccctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 149 - DNA, 11265 bp, Artificial Sequence
  Synthetic construct, pAG4758
tccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacccggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 150 - DNA, 28 bp, Zea mays
  misc_feature (1)..(28): PY_15 locus_Deletion
atggggaaagtcgccccgccgatagcga

SEQ ID NO: 151 - DNA, 32132 bp, Artificial Sequence
  Synthetic construct, PY_15 locus T-DNA
atgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccgtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtactatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcaggaattccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcggggacctaggtcacagctcgtccttctcgctcaggctgcaggccggaatcctggcctcgttcacgatctgggtgaagccggccaggctgcacatgccctgggcgttcctctcctcgcagccggccagggtcagcttcacctcgcccggcggggtgttcaggaacagcggggtcttgtccctcatctgctgcagggtctggaacaccaggctcacctgaatccactggctgttgtcgctcagcctcctccacctctcgaacaccagctcgccgcccggcggggtgttgtccggctggcccggcagggtccactgcagctcgagggcgccgcccaggttggccaggttggtgtcgtggccggcgatgaacagcacgctggtcggcagggtcacgccgtaggcctgcttctgcggcgggtgcggggtcagggcggtcttgatcaggtccagcagcggggtggccctgctcctggccacctccggggtcctctgcagcaggtcgaactgggcgttgtgcaggctcagcagggtgttccactggtggctgtcggtgatcctgccccagcccggctccggcatgccctgggcctgctgcagcaggaaaatctcggtcagcatgctggccaggctccaggcgccggtcaggctcacgttgtcggcgctcaccttcagctcgctcggcagggcctgggtcaggctggcgctctcgtcctgcttctccctcttcagggccaggttgctctgcgggaagttcagcaccctctccagctccctgaaggcggtctggtagtggccggtgaagtcggcgatgctgccgccggccctctccaggatggcgtcggtcacctgggccacgtccagctggcacacgccggtcttcagcgggttgaacagcgggtccgggctgctggtgtcggcctgggtgtgcacggtgatggcgcagtccggggccaggccggcggcgaaggcctcaccggtcttcctggtcctctcgtccacgtcggcgatgatggccacctggccgctctgcgggcagcccttcttcggcagcaggccgtcggccaccagcctctgcctccagtagtggcccaggtaggcgatcagctcgccgcccctcggggtcagctcgcccagcttcaccggccaggtgtagaacgcgtccggggtcacgtcctgcatcagctgggtgaacttggtcggggccctcacgccgtgcctgctcacgatcaccacgctctccagcttcagctccggctcgctctgggcagaggtggcgctggcagcaagagccagcagggccagggccacgagcagcacgcgcatggtttaggatcccgtgtagtgtctgtcactgtgatatgctcgggtgtgtgttgggttggctgtatgcagaactaaagcggaggtggcgcgcatttataccagcgccgggccctggtacgtggcgcggccgcgcggctacgtggaggaaggctgcgtggcagcagacacacgggtcgccacgtcccgccgtactctccttaccgtgcttatccgggctccggctcggtgcacgccagggtgtggccgcctctgagcagactttgtcgtgttccacagtggtgtcgtgttcctgggactccgatccgcggcgagcgaccgagcgtgtaaaagagttcctactaggtacgttcattgtatctggacgacaggcagcggacagtttgctgtaaatgaggggcagtttcccttttttttatagaaaaaacagagaattccgttgagctaattgtaattcaacaaataagctattagttggttttagcttagattaaagaagctaacgactaatagctaataattagttggtctattagttgactcattttaaatctctcggctatttttgatgcaaattactgtcactactggaatcgagcgctttgccgagtgtcaaagcctgaaaaacactccgtaaagactttgcctagtgtgacactcggcaaagagatctcgacgaacagtaaatcgacaacggcttctttgctgaatactttttatcggacacttgacaaagtctttgtcgagtgaactacattgaaactctatgattttatgtgtaggtcacttaggtttctacacatagtacgtcacaactttaccgaaacattatcaaatttttatcacaacctctatatatgatatcatgacatgtggacaagtttcattaatttctgactttatttgtgttttatacaatttttaaacaactggataacaagttcacggtcatgtttagtgagcatggtgcttgaagattctggtctgcttctgaattcggtcgtaacttgtgctagataacatgcatatcatttattttgcatgcacggtttttcatgtttcgagtgacttgcagttcatatgtgaattttccgaagaaattcaaataaacgaactaaatctaatagttatagaaaacatttttgtaattgtgccaaaatggtacatgtagatctacatagtgtaggaacataccacaaaaagtttggttggcaaaataaaaaaaaataaaatatactttatcgagtgtccaaggatggcactcggcaagcttgctctactgagtgtcggacgagggggcactcgacaaagataacgaccgtcagctttagacggcggctgacgaccctttgccgagcgctgccgttcgccgagtgtttggctctcggcaaagatttctttgtcgagtgtatttctgtgtcgagagtcctgctctcggtaaacgcggtcgttaccgagagcaggactttgccgagtgcggcacatggcaaagacttttttgccgagtgctggacaaaaagcactcgacaaagcgcctcacactcggcaaagagccggattccggtagtgtgtatggcgtacctacaaatttttattgaatgtggattgtatgtatagttctaaggtaaaagaaaggaaaaggggagtgtcactatgttacaaagtgttgtatccagtttctacttttagctcctgtctcgagcttaacttggtagcagatgtagttcatttcagtcttgaacatttccttgcaggccgccaccgttggcggtatgttttcgaatatccagttatttcgacatttccatatgcaccatgacatggttataataccttccattctccacggcattgttagtcttgctctaatatgtagcactgcaagcgttagatccaaagttcggggcggagtgattccaacagtgagccaacatctttgggcaaagttacaccgcaggaagtggtgagatatagtttcttccaactgtaagatgcagttttcgcatgtgtaggagtctaaacgcatgccctgacgtcttaggagagatctagtgttcaatctatctcttagcagcaaccataagaaaacctttcactttggttgacattttgtcttccaagtccaggagtatacaggatgggttcatgcctctcaagctgtaaaccctgaataatgccttaaagaagttgtagctagttctttattattttataggaataatagtagagatttgtacgactttagttattcaatattagagttatttttagtatgtgtcttattctggaggcatatctcttttaaatcaagaggatgataaattatgttacctaaattattcctattaggttatataataacgtgagttccttgcttattgagtttcatacatgaaaataactattttgagcaaagtataaaagaaaagtaaatacataaacataaaatatatttgcattcatgctggtattttggttgtgtattttgaaattgaactctaaatccaaactggtatttaaattcaaaatagaaatctaaaaatgtggatttgaaagattgagaattgaaacctaaggaagaatgtgattaagtcaattattctcccctaagtaaacaatatggggtagaataaaaaaattaaaagtaatagtaggggttaccttatcatataattttagtgtacaatttagaagctgaaattcaaaactcgaatttgaatttagtttgaaagcatgaaaattaaaagaaaggaaaatagaaaaggaagggaaataaaaagagaacctagtcggacttgagttatcaatttcagcccatctaccctacgcaccgcgctggcccactcaatcccctccccccgcccgtgtagtacactggcacaacatgcatactgaattatcgtttcaagcatattattacaaataaaaaataaaataatgcataaattattttatgtattatttgctccctacaacaaatttttttaaaagtactgaatttgtttccaaattcataccgggtacccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcggggacctaggtcacagctcgtccttctcgctcaggctgcaggccggaatcctggcctcgttcacgatctgggtgaagccggccaggctgcacatgccctgggcgttcctctcctcgcagccggccagggtcagcttcacctcgcccggcggggtgttcaggaacagcggggtcttgtccctcatctgctgcagggtctggaacaccaggctcacctgaatccactggctgttgtcgctcagcctcctccacctctcgaacaccagctcgccgcccggcggggtgttgtccggctggcccggcagggtccactgcagctcgagggcgccgcccaggttggccaggttggtgtcgtggccggcgatgaacagcacgctggtcggcagggtcacgccgtaggcctgcttctgcggcgggtgcggggtcagggcggtcttgatcaggtccagcagcggggtggccctgctcctggccacctccggggtcctctgcagcaggtcgaactgggcgttgtgcaggctcagcagggtgttccactggtggctgtcggtgatcctgccccagcccggctccggcatgccctgggcctgctgcagcaggaaaatctcggtcagcatgctggccaggctccaggcgccggtcaggctcacgttgtcggcgctcaccttcagctcgctcggcagggcctgggtcaggctggcgctctcgtcctgcttctccctcttcagggccaggttgctctgcgggaagttcagcaccctctccagctccctgaaggcggtctggtagtggccggtgaagtcggcgatgctgccgccggccctctccaggatggcgtcggtcacctgggccacgtccagctggcacacgccggtcttcagcgggttgaacagcgggtccgggctgctggtgtcggcctgggtgtgcacggtgatggcgcagtccggggccaggccggcggcgaaggcctcaccggtcttcctggtcctctcgtccacgtcggcgatgatggccacctggccgctctgcgggcagcccttcttcggcagcaggccgtcggccaccagcctctgcctccagtagtggcccaggtaggcgatcagctcgccgcccctcggggtcagctcgcccagcttcaccggccaggtgtagaacgcgtccggggtcacgtcctgcatcagctgggtgaacttggtcggggccctcacgccgtgcctgctcacgatcaccacgctctccagcttcagctccggctcgctctgggcagaggtggcgctggcagcaagagccagcagggccagggccacgagcagcacgcgcatggtttaggatccggtgtcgatcgggttcttctgcgctctggagtagataaagctaatggtctgaagacccagtggtggtgatggagaagtgcacaggcatgcgagcgttatttatagctttgattaattaacacaatttcttgtgttcttatgccaccgagacggctgtaggcagcttcatggtttcttgccaaatgtatatgactcgtcactctctttacgtagcacgtcgatggttcatctggaatcattctgtacttctgcgtggctcagttttgttgccttctacaggttgttgatctacgtaaaacgaattagatttagcttgacatatggctttttttttgttgtaaatttactttacacgtcaaggatttttgtcctgttccggcctattttatttttcatgaaacgatctttgtaatgcaatatgagttgtttgtaatgtcttgtgagctgtaagcatgtatatcagatgagtatgatctcggcatgactcaccgtgtttctttgcacacagagaggatttgtttgattgtttcttacccaatacccttgacgtgcaattttggttgatgttctgtgagttgttaaggatacaacgaattcttggagctttacatgccaatgcatggttgtttcgtgttcctcaacatttaaggacttattcggttgcacctggatcgaaggggattgggagaaatcgattaaatctccttctatttaattttgactaggaagagatttaatcgtttccaacccctttcgatccagacgtaagcgaacaagttatttatttggatacctcttattcatcttaatacacacatggtattaagttgccactagtcatatgcctgtgcattgctacggtttatattatatatatatatatatatatatatatatatatatatatatatgataaattttgttttaataaaacatatgttttctattgattaggttgtgtgaatatgagccaacaaccaaggtccagaacacttatacataatttcaccttattttgtacataaactctcttattatagtagtaagagaagagattataagagtgcgggttgattataaagaaatgtaggagttttttaataatattgacacgagacgatcgttgaactggtgctttaatatagtaaagataaagattggtgttggggacttgttctcaaatgctatgaattaagaacaaggcaacataaaatgttaaatatcaaaatccttcgtccttcgaagcattattttcctttggatataatggatttcggacgaaggttatgaaggtcataccttcataatcataatcaaatgaaaaagtaaagaagattcacacataaaataatatgattactttggtacccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcggggacctaggtcacagctcgtccttctcgctcaggctgcaggccggaatcctggcctcgttcacgatctgggtgaagccggccaggctgcacatgccctgggcgttcctctcctcgcagccggccagggtcagcttcacctcgcccggcggggtgttcaggaacagcggggtcttgtccctcatctgctgcagggtctggaacaccaggctcacctgaatccactggctgttgtcgctcagcctcctccacctctcgaacaccagctcgccgcccggcggggtgttgtccggctggcccggcagggtccactgcagctcgagggcgccgcccaggttggccaggttggtgtcgtggccggcgatgaacagcacgctggtcggcagggtcacgccgtaggcctgcttctgcggcgggtgcggggtcagggcggtcttgatcaggtccagcagcggggtggccctgctcctggccacctccggggtcctctgcagcaggtcgaactgggcgttgtgcaggctcagcagggtgttccactggtggctgtcggtgatcctgccccagcccggctccggcatgccctgggcctgctgcagcaggaaaatctcggtcagcatgctggccaggctccaggcgccggtcaggctcacgttgtcggcgctcaccttcagctcgctcggcagggcctgggtcaggctggcgctctcgtcctgcttctccctcttcagggccaggttgctctgcgggaagttcagcaccctctccagctccctgaaggcggtctggtagtggccggtgaagtcggcgatgctgccgccggccctctccaggatggcgtcggtcacctgggccacgtccagctggcacacgccggtcttcagcgggttgaacagcgggtccgggctgctggtgtcggcctgggtgtgcacggtgatggcgcagtccggggccaggccggcggcgaaggcctcaccggtcttcctggtcctctcgtccacgtcggcgatgatggccacctggccgctctgcgggcagcccttcttcggcagcaggccgtcggccaccagcctctgcctccagtagtggcccaggtaggcgatcagctcgccgcccctcggggtcagctcgcccagcttcaccggccaggtgtagaacgcgtccggggtcacgtcctgcatcagctgggtgaacttggtcggggccctcacgccgtgcctgctcacgatcaccacgctctccagcttcagctccggctcgctctgggcagaggtggcgctggcagcaagagccagcagggccagggccacgagcagcacgcgcatggtttaggatccgttgttgtaggactaatgaactgaatgctttttgtgagaaacaatgagaaatcatcgtgcatttatagtgagataaaggctcttgcatctaaatgttaagatagagtttgttaatgtccagacatgaagtgactcatgatatatgaagtgtggtacacgaaaggtggatgaataatgatggacatacagatatgtataattgacgcagcattgtgttgttctttctctctttcttttgcaatatgacatggataatgtaaagccctcctctttttgacacgaaaggcaaatgaatttttgtgagtcatgccttgtcttataagctctcctctttttgcaatatgacatatagctctggagttttatgtacacatcattttgctttatcttgcttgagtctgtgatttgtcatgtgtcacgcctaatactcatcaaacgtgacttatgggtttatgttctaacatttagcggagaattaagggagtcacgttatgacccccgccgatgacgcgggacaagccgttttacgtttggaactgacagaaccgcaacgttgaaggagccactcagcctaagcggccgcattggacttaattaagtgaggccggccaagcgtcgatttaaatgtaccacatggcgcgccaactatcatgcgatcgcttcatgtctaactcgagttactggtacgtaccaaatccatggaatcaaggtacctccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacccggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatttgtttcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcctaagcggccgcattggacttaattaagtgaggccggccaagcgtcgatttaaatgtaccacatggcgcgccaactatcatgcgatcgcttcatgtctaactcgagttactggtacgtaccaaatccatggaatcaaggtacctccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggatacacgactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcctaagcggccgcattggacttaattaagtgaggccggccaagcgtcgatttaaatgtaccacatggcgcgccaactatcatgcgatcgcttcatgtctaactcgagttactggtacgtaccaaatccatggaatcaaggtacctccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggcgat

SEQ ID NO: 152 - DNA, 15147 bp, Artificial Sequence
  Synthetic construct, 3293_Locus_T-DNA
cactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcctaagcggccgcattggacttaattaagtgaggccggccaagcgtcgatttaaatgtaccacatggcgcgccaactatcatgcgatcgcttcatgtctaactcgagttactggtacgtaccaaatccatggaatcaaggtacctccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacccggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctcctaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgctttgtcgagtgctttttgtccagcactcggcaaaaaagtctttgccatgtgccgcactcggcaaagtcctgctctcggtaacgaccgcgtttaccgagagcaggactctcgacacagaaatacactcgacaaagaaatctttgccgagagccaaacactcggcgaacggcagcgctcggcaaagggtcgtcagccgccgtctaaagctgacggtcgttatctttgtcgagtgccccctcgtccgacactcagtagagcaagcttgccgagtgccatccttggacactcgataaagtatattttatttttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgaattcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacagacactacacgggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcct

SEQ ID NO: 153 - DNA, 8439 bp, Artificial Sequence
  Synthetic construct, Locus_3507_T-DNA
aacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcctaagcggccgcattggacttaattaagtgaggccggccaagcgtcgatttaaatgtaccacatggcgcgccaactatcatgcgatcgcttcatgtctaactcgagttactggtacgtaccaaatccatggaatcaaggtacctccatgctgtcctactacttgcttcatccccttctacattttgttctggtttttggcctgcatttcggatcatgatgtatgtgatttccaatctgctgcaatatgaatggagactctgtgctaaccatcaacaacatgaaatgcttatgaggcctttgctgagcagccaatcttgcctgtgtttatgtcttcacaggccgaattcctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgcataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgggcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctcacaaaaagcattcagttcattagtcctacaacaacggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacccggtatgaatttggaaacaaattcagtacttttaaaaaaatttgttgtagggagcaaataatacataaaataatttatgcattattttattttttatttgtaataatatgcttgaaacgataattcagtatgcatgttgtgccagtgtactacacgggcggggggaggggattgagtgggccagcgcggtgcgtagggtagatgggctgaaattgataactcaagtccgactaggttctctttttatttcccttccttttctattttcctttcttttaattttcatgctttcaaactaaattcaaattcgagttttgaatttcagcttctaaattgtacactaaaattatatgataaggtaacccctactattacttttaatttttttattctaccccatattgtttacttaggggagaataattgacttaatcacattcttccttaggtttcaattctcaatctttcaaatccacatttttagatttctattttgaatttaaataccagtttggatttagagttcaatttcaaaatacacaaccaaaataccagcatgaatgcaaatatattttatgtttatgtatttacttttcttttatactttgctcaaaatagttattttcatgtatgaaactcaataagcaaggaactcacgttattatataacctaataggaataatttaggtaacataatttatcatcctcttgatttaaaagagatatgcctccagaataagacacatactaaaaataactctaatattgaataactaaagtcgtacaaatctctactattattcctataaaataataaagaactagctacaacttctttaaggcattattcagggtttacagcttgagaggcatgaacccatcctgtatactcctggacttggaagacaaaatgtcaaccaaagtgaaaggttttcttatggttgctgctaagagatagattgaacactagatctctactaagacgtcagggcatgcgtttagactcctacacatgcgaaaactgcatcttacagttggaagaaactatatctcaccacttcctgcggtgtaactttgcccaaagatgttggctcactgttggaatcactccgccccgaactttggatctaacgcttgcagtgctacatattagagcaagactaacaatgccgtggagaatggaaggtattataaccatgtcatggtgcatatggaaatgtcgaaataactggatattcgaaaacataccgccaacggtggcggcctgcaaggaaatgttcaagactgaaatgaactacatctgctaccaagttaagctcgagacaggagctaaaagtagaaactggatacaacactttgtaacatagtgacactccccttttcctttcttttaccttagaactatacatacaatccacattcaataaaaatttgtaggtacgccatacacactaccggaatccggctctttgccgagtgtgaggcgc

SEQ ID NO: 154 - DNA, 13592 bp, Artificial Sequence
  Synthetic construct, Locus PY_209
gcaagtccaggacacagacaaagactagaaagaacggcactcgtgtgcctgactgatgcgccacgccagcgaacacatgtcacttgtacactactgcgtgataaaagctgagagccggagacatcaggtataccaatatcagcaagatgccatcgctgatgacacaaaggggcatggcagatcagcaagacaagaagattgtaccatatgtttagcgttgttgtccgtcatgatttcgataaaaagtacgagcaggtgttgtgtgtgagcgatcagccttctaataacaacagagtaggtggcgagatgtatggaggtggagagtgtgcacctccatacgtgacgtcagcgtccatataaaaggcaagtgcacgacaattgatgaatccgcaagcttttcagaaagcactggtgtacagtacaaggccatacgactaccggatttgatgtaatttacttatatagtgtttggttgaggagcagccaagtataacggaaccattccatccctcattctaagaacggaaccgctctgttctatgtttgataatctggaacagaaccgctctgttctgtgtttagttgcagagtgaacggaacagaacgtgactgtgagaacaggataggaacggagcggctccgtccgattgattttttgaagcggaatggttccaaatctgaggagaatattccctaattaaaaccattccgttctagttactttgtaactaaacagcaacaaaactgagacagaacagctctgttctacttgactcttcaaccaaacactaccttagactgccggattcggcgtaatttactggttcgagggatggcttcaaccggagcagctccaccgcgctctaaaatttggcctgcatatagacacaatctaattttttctctctcgctacattgaatcgagctagcctaggaatgacatgcagccaaaatttaatacgcctcatctgaaataaaaagaacatagaggcagcagcatcagtggcagtgctaaaccgcagctgcccgagcaccagctacagctatagctacgaaatcgtaaagccggttacatttggcagaacccagatgtctggaccaaaccgtctcggccgctaagtgcgtaccgctggtgctggtgcgccgcagccgccgaaccgagcggttccgctgaacaggtgtacgccctacctggatcccttcctctatgtacaatgccgctggaagagtagtccgagacgaagcctgtgctctccgagaagtaccttgtctgtgggttggaaggcgaggagagcctcgtgcacgcggcgaaactgccaggtggaccgggatgatgctccggggcatagcttggcccaaatatcgaggagattgggtccaggccagcgttgtcgccgtagtccacgacgctgaacgagtccctcgtgctctcggtggtgaatgaggactcgtccgagctggtaaacagcgaccattcgcttgacgtggcctccgagaagtccgcgctaaccgagtctgcgaaggcatcgtcggcgcgatggaattccctggatctcaactctgcttgctgatcttgcgtgtagccctcgccatcgggtctaaagtcataaacaccgtatgctggatcgttcgccgagaggagtaactctgtctgctcgcgctcgtgtttagagcccttggaatactttgatgtgtggcgcttcgcggatggaacagtcggccccttctcgatgtatattcttggtggtcgggggaaagacctgaatggtatttttacgaatatgagatcgctgcagagtgcaggcacagatactccatatgcaacttaggtacagcaaattatatgtttcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtatacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaagttcacgcagctcatgcaggacgtgaccccggacgccttctacacctggccggtgaagctcggcgagctgaccccgcgcggcggcgagctgatcgcctacctcggccactactggcgccagcgcctcgtggccgacggcctcctcccgaagaagggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacgtggcccaggtgaccgacgccatcctggagcgcgccggcggctccatcgccgacttcaccggccactaccagaccgccttccgcgagctggagcgcgtgctcaacttcccgcagtcgaacctcgccctcaagcgcgagaagcaggacgagtccgcctccctcacccaggccctcccgtccgagctgaaggtgtccgccgacaacgtgtccctcaccggcgcctggtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgcagtggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctcttcctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgttaattaagtctaactcgagttactggtacgtatacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaagttcacgcagctcatgcaggacgtgaccccggacgccttctacacctggccggtgaagctcggcgagctgaccccgcgcggcggcgagctgatcgcctacctcggccactactggcgccagcgcctcgtggccgacggcctcctcccgaagaagggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacgtggcccaggtgaccgacgccatcctggagcgcgccggcggctccatcgccgacttcaccggccactaccagaccgccttccgcgagctggagcgcgtgctcaacttcccgcagtcgaacctcgccctcaagcgcgagaagcaggacgagtccgcctccctcacccaggccctcccgtccgagctgaaggtgtccgccgacaacgtgtccctcaccggcgcctggtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgcagtggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctcttcctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatctaaaccatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacctcatgtagaaaagcatatatgcaccttctgacataacttgattcactgatacaacctggacctacatatggaacaacataaatcaccacaagatatcataaactctcgagttttttttcctttcctatttcatttcaatgagcctataaacctacaaggaaaagcacatacatatgtgcaccaaagaagtttgacaacaaaactgcatcaaggaagacagcattgacgatcaaaactgcccatgggaacgttcactatccttacactagagtttaaatctagaaacacaatgtcacgaaaccatagtaatttctcgcaattcatacattaggtgataaggtaagacattcttagcctacttaactggagtaggccttgttgtaaaacgtacctctgaatcatcaattctcaaccatgtaccctgcatatctttgacatatgatatatagtgcccagagaatgatgcattttctgtatccacatgtacaaccacggcatacaagaaataaagagggggattgtcaccagacccagtcacaaaaggaaccatgtccaacatatcagggaaagtaacacatttgttgatcttgccatattttcctgactgaaataataaaataaagttcatttagttcttcatcaagaaacattcaagtggtacaaaactgtcagctcgagcatagaacatgagccatgtgataactgatccaagtcaacaatatggaaatttccccaaacgagcttcattacccgtccctgtttcctagggggcgcgtttggttgccttctccaggctccggggaaatcgagactagatagtataaacagagaacctagttgatagcttcatgctactaaaagcagaccatcaagcttcaagcaaagacaagttgctgaggtgtgacccaggcacccagcaatgactaaccctaagagcaggagttcatcatccccagacctgaattgatggaggtgtgactcagcggtagcaggttatttatccggcagtgcttgactccgctagtgcagggaagaaagccttcagcttcaccttcatgttgacggctgagacaggaaggagaggcagcagcagcagtgggaaaacaggcggtacagcagcagggaaggccagaaaagaggggaagacctgtggtgtcagggatggttgtggcacgaagtcctggtggctggggttgcttctcacaggtcagggccaagcgagtaattgtggaggggtatacaagagaaactcaattgggttggggccaaaacacaactatagaccagtgactttgacctgatgtagcacagttcacaattgccagcccattcatccaacacaactaatcagacaattgatcatgattagccaacggctatcagacaaccagatttctggtcaccctaattgagtccagaaaggaccgttggctaatcagacaaccagatttctggtcaccctaattgagtccagaaaggaccgattagaacaattgatcatgattaatcggatgacttgataattatgtcattcatttcaagttaatattaccaagtaccaacaaatgtgggtctaaaaatgctaatgcatgcttcaaagaattggctgaacattgcaccctgcataaatacttatcagatccaaccggtattacgtgatgaaattcaatacaaaaacaattacctgaaatcttttaagaacaactgttaatatgtttggcacctcatgcacgctcagttgcttcctggctttaacataggcagcacaactgcat

SEQ ID NO: 155 - DNA, 9968 bp, Artificial Sequence
  Syntheic construct, PY_209_T-DNA
tcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtatacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaagttcacgcagctcatgcaggacgtgaccccggacgccttctacacctggccggtgaagctcggcgagctgaccccgcgcggcggcgagctgatcgcctacctcggccactactggcgccagcgcctcgtggccgacggcctcctcccgaagaagggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacgtggcccaggtgaccgacgccatcctggagcgcgccggcggctccatcgccgacttcaccggccactaccagaccgccttccgcgagctggagcgcgtgctcaacttcccgcagtcgaacctcgccctcaagcgcgagaagcaggacgagtccgcctccctcacccaggccctcccgtccgagctgaaggtgtccgccgacaacgtgtccctcaccggcgcctggtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgcagtggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctcttcctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgttaattaagtctaactcgagttactggtacgtatacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaagttcacgcagctcatgcaggacgtgaccccggacgccttctacacctggccggtgaagctcggcgagctgaccccgcgcggcggcgagctgatcgcctacctcggccactactggcgccagcgcctcgtggccgacggcctcctcccgaagaagggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacgtggcccaggtgaccgacgccatcctggagcgcgccggcggctccatcgccgacttcaccggccactaccagaccgccttccgcgagctggagcgcgtgctcaacttcccgcagtcgaacctcgccctcaagcgcgagaagcaggacgagtccgcctccctcacccaggccctcccgtccgagctgaaggtgtccgccgacaacgtgtccctcaccggcgcctggtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgcagtggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctcttcctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatctaaaccatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttac

SEQ ID NO: 156 - DNA, 2314 bp, Artificial Sequence
  Synthetic construct, PY_1053_locus_RB flank
aattgatcgagacggcaatccccctcccctccgcaccgctccgctcccagcggccgacaagccccgcccgtggccgctatcgcgcgcctggaccaccgctccgcccaccgcccgatccccgtccgacggccccggctcgccgacgataaagatggagacgaccgaatttaacccccccaaaaaaaaagagcgtcactcgcacgtacagctagcacgctcgaagctaacaagagctagctctctggcgcgtctgtactccgatcctgtacggtggtgcggcgccgcggctgaggctagctcgatcaccggcgccggcctcatcctctcctcctcatcatctgtctctcttccgaccccgctagctcaggcggattagacagaaaagtcaagacgaccatgcagactgcccgcatggccggagaaacgcgcgcgacgcatgcaccgagctatctatcccctcaaccgcctctcttaaaaccccaccatcactgcgcgctaaacgctacagcaagaaagcctagaaaaagggcctggacgtgccgaacgccgagcaggtcaacgtacggccaggatcatcagcaaggaaaaaattaataaaaaagggcgaagccggccggttggattattagcggttggggacggattgattaggcctgcacagcacacacgcgcgcagtagtagcgtcgtcaggtttagggtgtgtttggtttgacttttggctttggcttttgtttctctaaaaaccaaaagccaaccaaagggctggatctaggaagcagctttttctaaaagccgactttctcgtagtgcaaatctgaaagcacctctggacctgcttttagtggcttttcggatggaactatgaaaacatatatcgaagaatttttaacgacttttagtggtttccatcaaacggtttttagctttttaacaacttacagcctacagcagctttttccacagctcacagcccacagcaacttttttcacagccacagcccaaccaaacagacccttagcgacgctctcgcacaccacagccgcacgcgcgcccgcgtggttgagacgaatctgcagcggcgcaagcgcaacagcaatcccgctttcgttttcctttctccatttaattaaatgtttcatcagaaagcaggcggggaaaaaaataaagcataggagattcgtcgcacccaccaccggccgggccgagatttttttttatcattttctcggtttcgcaataaaggcgaggacgtaaacatatggcgttggttggatcggaggagctagctagcatagcacacggaaagttttgcttatcttttttatatattttttgcataaaaaaaagataatttgatctgccggggtggattatttcctcctcgcgcgcctcggctgcaggggcgtccccgagtgctggtcaatttcgaaatgaaaaagaaaagatggaaagacgcagagagggacgcctcctcatcgctttcttttcccatcagacgaccctgccccctttacttgctttccatctgtttttttcctcccctctgcctccctgctggataatactcgacatgatcaacatcatcttccattccaccttgtatctagctcgcacagcgagcgaggggagcgagatagttggtcggctgccggtacggtgtgtgtacatgtactagctaggcgctcgctcgaattgttgcatgttgagaagtacccatatatagcggctagctgcagctagtctcttgctaaaaatcagctgtaaagtcattcgaggatagaaaacaaaagagccatgaaaaggatatattgtggtgtaaacaaattgacgcttagacaacttaataacacattgcggacgtttttaatgtactgaattaattcgagctcgccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcggggatctagagctcccagcttagcaagagatgttaattttttcagtaagctcttacagcttgttgtaaacacgcgctaaacggccgtggcctttgacagtcaccggtgattcgttggcggcaataaacgctgattcacccggtttaagc

SEQ ID NO: 157 - DNA, 2248 bp, Artificial Sequence
  Synthetic construct, PY_1053_LB flank
gcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaaaagagctagagtggatgggtgggggggacaaatgaaaacaagcgtacgacatcaccagcaccagcaacaataacttaaccacaacacaacaacgacgcccgattattaaacgcggtacaagcgagggcataaaagaaaaaagagggatccccaaaggaggaatggagagggagagctagcgaggccagggacagcgacgtcttcctttcctcctccccccctctggactgagcacgcccccgtccaactccaatatctgcagcagcagtcacggcggcaggaggagagctagggaggggaaaaggagctcggtttttttatataccaaccggccacccgccctacgcgctactactatagcctagctagagccagctgcttgcctcgccctcccctttgcgcgtcgtcgcgctcctcgccgtccccctctctcggaatcggaaggcgatcgatcgcacaaggctgcgtctgcgtgctcggccgccgcccgacccgaccggacaaggaggggagggggcaaaaaaaatatatagttagtcacacgcacgcagcacaggagggaggagagggattgagggataaagaaatttcgggagacaaggagagagagacagagatggagaggagcggctggactcggaggcaggcctttcactactcccgcacccagataacgatgtggtagctagttcctcttaggctaaggtaagcagcagcgccgggagctagctcctcctcactatcctgcatgcttcgttccttcgttcagctttggttgcccggtcgatcgatcggttcttttttgtttcttcgtatacatgcaaagctagctagttggagagttcctttatttttcgatttctttgctttgggagagtgcaattcggttcatcgtcttcttaatttggattctatattcgttttccccgcctggccggtgcttattacgatggtgctgctgctgctcatgagcttcgcaggaaggaggtcgtggccgggatcccgccgatgatgatgacagtggcgccgccggcatgggcgtagcggcgccaccgtacgagaccaccacgtacgtgagccaacgcaccaagatcaacatcgcagcgatctccgccgccgccgccaccagggcggctaccgcggcttctatgtcccactcgcagggattccaccagggcagcgccggcgtctacggctactcctcggatggcttcgaccgcccggacgactccggccaccaggaccatcatcagcagcagcagcacgtggcgcagcagagccgccgcgacaagctgagggtgcaggggttcgacccggccgccggcggcggccacggcctgctccccatcgagggcgacgagcatggcgggcccgggtccatgtacgagcacgcggcggccgcagctggggcctccaacatgctctccgagatgttcaacttccccgcgccgccgtcggggccctccgccaccgagctgctggccagccagatgggcgccaactaccgcttcggggggctacggcagcagcagcagcaggggcccggaggggtggtggctggcttgtccggcgacggcggttggttcgtcggggccggcgcggcgggtcgtgctgctggcttggtcctcggtggtggggccaacatggggtcgttaggtgaaacgtcgtccccgaagcagcagggcagcatggctgggctggccaccgacccggccgccgcgatgcagctcttcctgatgaaccc

SEQ ID NO: 158 - DNA, 2314 bp, Artificial Sequence
  Synthetic construct, PY_1203_locus_RB flank
ccctggtggcgtttgtagttgcggtgcatcccgcaacaaaaatgctaggccgcccccgaggcccgaactttcctgctatccgccccgtccgtggccgaggccggagaaggcgcaccacgccaccacgggcgggcgtgcgcgccgagtcgccgactggcggctgagtgtctgggtttcggcctcagtcgcgggaaaagcagccacggtgctcactgctcgtgctttgtttcgaggtggtcttgctctgtgacgtcacaactcacaaaggaaagggctcctgcaatggaggaagtgctcaagtgcatcttctttctccatatcctgtccttttcggtgccccgaacgtccaagactttagaaaaagaaagatatttttgccattactattctaagccaagtttataagaagaaaaaaacagtcatgtatttatgaattatgacatcaaatgagcactgctagcttcgttttaagctatgttttcatggtttcgctctctgtcgtgataaatgttaatatccttctatatgaatatagtcaaacctttacaagaaaaatagtatatatagagagcaaagcttcggtgaactcgatgctgattgcccttgaataagcgtgctcactgactgtagtatcgtagctaaaaacttgcacgagtctgaacagttctggttattacaaaaatatgtacctaaaaagaatattctctttattttaaattattgattattttgaattttctgtatataaacgctgaaataatttatattttaaaaccgaggaagcagtgttttttacatataaagatctttttgtactttgtcgacgatcaagggtccccggatgggatccaccgcctacggtaccgatttttgtgattgtattactcagaaacaagcttacgcctcatcagacgagcatgtgtgctacgggagtgatctcctgcagttctatctgctgcctccactccaatcagcactcagcgaagtcgtacggggtgtttggttggtagaatgatacgatgcatcgtcgtagatgagagatggacatagaccgatagctccgttttgttttttttttgggacccccctccgatcaagtgtatgacgcatactataggataggccagtttttgtttgtgtccggtgcccttttgaaagtacttggtcagagagctataggagaaagctattattgtaaattacttttaaaaaatatagtcaccttaatttatgacaatatctataccaaattacaattaaataaaaatatatgtccatggtacatatgctactataaatcatattaatgtttatcatgatattatggtaaattacttagaataaaatgaatgagttattgtactctcgcaaactagtagagtaattatcatagcttaaagagtctacaaaataaattattttatgatcatctatatatagaaccgttagggacggatctagaaaaaaaccagaaagctaaagtagtattataataaaaatcgaactctaaataaacgataaaaactataaaatatataataagattataccatgtacacttaaaattttaaaagagattttagtgaattttcatggacttgagagcggtaggaggggctagagcatcagtcacaccgttacatccgtgtctgagaaccgcattgtatatgcaatttttcttgacaagaggaaacccaccttttatagaaagcttaaggagtaacaacattcaactttcaaactactgggtttagcagcttacaggcaggaacaaggccgcaaataaagatatttgtggtattttaaacttggaataatattattgatactaaaaaggcacgaccgtcaaagccgctagattcgtcaacatgtactgaattaattcgagctcgccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcggggatctagagctcccagcttagcaagagatgttaattttttcagtaagctcttacagcttgttgtaaacacgcgctaaacggccgtggcctttgacagtcaccggtgattcgttggcggcaataaacgctgattcacccggtttaagc

SEQ ID NO: 159 - DNA, 2252 bp, Artificial Sequence
  Synthetic construct, PY1203_LB flank
gcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgttgtttcaaccctcatagtcatagaagccacctatcttgaccagcagcccgccacaccttccgacgatggatatccgatcataagattcattccactacgaaaataacctaaagataaaccctctcctagcccctgcccaccaccatgtgcacacaaaccccaactacgtaacacatgcgtgcttcgtcgccatcctcctctatataatttacacaatttcttgcgactcccaagtagccaagtatttgcccaaacactgcgtactgaccggcagatacgatccacctcaaacgtgatacgcgacaacatactgaaaaaggcaagcacgtaacttcagctcggtttcaatttgctcctgattttttttttacacctggctgctggtcgccgccgccaccgccgccgccggctcgacacggttctgcgcggacttgagcatgaacccaccaaccccggccttgtcgccagggtcctcgtcgtggtagacgtaggcgaagccgccgtgccgggtcaggtccatgccggacatctcgtcgtcggccgagatgcgcagcaggcccagcttcttgagcgcgtagaagagcgggcccatggtgcagctcacccacccggcgatcaccaggatctggatgatctgcgcggcgaggagcttcccgccgccgcccatgaacagcccgtagggcctcccggcgccgtagatctcctccacgtactttcgcctcgcgaagagccccgtgaagaggacgccccaggcgccacacccgccgtgcagctgcgccgcctccagcgggtcgtcgaacctgaagcgcgccgcgagggcgttggcgccgatgagcacccacgcggacacgaacccgcagatgacggccgcccacggctccaccacgctgcacccggccgtgatggccgcgaacccgccgaggaggccgttgcagacgtccaccacgttccagtggcccgtctggagccgcttcccgaacagcgtggtgagcgcggcgacgctgccggcgagggtggtggtgacggcggtgcggcccacggccgaccactgcccgtggacggtcccggcggggccgtacgacttgaggatggtggtgaaggacccggggttgaacccgtaccagccgaaccacagcaggaaggtgccgagcaccacgagcgacgcgctgtggcccttgagcgccacggagcggccggcgtggtcgaagcgcccgatgcgggggccctcgatgagcgcgccccacagccccgcgatgccgccgaccatgtggacgacgccggagccggcgaagtcgatgacgccggacccgaagagcagcgggccggacgtgcggctggcgccggcccagccgtcggcggaccagaaccagtgcgacaccacggggtagacgaaccccgtcaggaacgcggagtagatgaggtaggcgacgaactgggtccgctcggcgatggagcccgacgtgatgcccgcggcggcgatggcgaaggcccactggtagaggaagaagtcgtagtcgaagccggtcctgggcaggtgcttgagcccgaagaactgcttgccgatgaagccgttggagggcgtgccgaaggcgaaggcgaagccgaagaggtagtagaagagcgcccccgcggcggcgtcgagcacgttggtgagcatgatgttcatggtgttcttggcgcggacggagccggcgcacagcatggcgaagccgagctgcatggcgaacacgaggtaggccgagaagagcaggtacgtggc

SEQ ID NO: 160 - DNA, 24 bp, Artificial Sequence
  Synthetic construct, PCR primer 456
ggcgagctcgaattaattcagtac

SEQ ID NO: 161 - DNA, 21 bp, Artificial Sequence
  Synthetic construct, PCR primer 513
aaacgtccgcaatgtgttatt

SEQ ID NO: 162 - DNA, 24 bp, Artificial Sequence
  Synthetic construct, probe PB21
acgattctgtcctgtggtcactgc

SEQ ID NO: 163 - DNA, 32 bp, Artificial Sequence
  Synthetic construct, probe PB22
cacagatactccatatgcaacttaggtacagc

SEQ ID NO: 164 - DNA, 21 bp, Artificial Sequence
  Synthetic construct, PCR Primer 889
aggtccaggttgtatcagtga

SEQ ID NO: 165 - DNA, 18 bp, Artificial Sequence
  Synthetic construct, PCR Primer 909
gagatcgctgcagagtgc

SEQ ID NO: 166 - DNA, 19 bp, Artificial Sequence
  Synthetic construct, PCR Primer 925
ggtgatgtcgtacgcttgt

SEQ ID NO: 167 - DNA, 24 bp, Artificial Sequence
  Synthetic construct, PCR Primer 926
agctgtaaagtcattcgaggatag

SEQ ID NO: 168 - DNA, 22 bp, Artificial Sequence
  Syntehtic construct, PCR Primer 508
tgttactagatcgggaattggc

SEQ ID NO: 169 - DNA, 32 bp, Artificial Sequence
  Synthetic construct, probe PB23
ctctctctctccttttcatggctcttttgttt

SEQ ID NO: 170 - DNA, 22 bp, Artificial Sequence
  Synthetic construct, PCR Primer 908
atactaaaaaggcacgaccgtc

SEQ ID NO: 171 - DNA, 21 bp, Artificial Sequence
  Synthetic construct, PCR Primer 890
tggtcaagataggtggcttct

SEQ ID NO: 172 - DNA, 25 bp, Artificial Sequence
  Synthetic construct, PCR Primer 855
atgattagagtcccgcaattataca

SEQ ID NO: 173 - DNA, 20 bp, Artificial Sequence
  Synthetic construct, PCR Primer 886
tccctctccattcctccttt

SEQ ID NO: 174 - DNA, 20 bp, Artificial Sequence
  Synthetic construct, PCR Primer 887
cgctcgaattgttgcatgtt

SEQ ID NO: 175 - DNA, 41344 bp, Artificial Sequence
  Synthetic construct, PY53 locus
gcaggaaggattgatcgtgtagattgtagtttagatgaatgtcatgaaattacagaagccacaagggaacaggtctgaggcttacccatatgctttgcttttatcaggaattcaagatctggtgtaatttagtaagactgatgaaattatttataggtcacaatcatccatggagatctaagtgccttccagaaggaaatggaaacagttcatcttgtagttcgtagtctggtaggtacattgtaccatgtttatttctccctttctgttcaagatgaactgattcacttgtagtgctaactacaaactgattacctgttgtgttgcaggaggcaaagcttggacgcctagcttatactcaagtagacatttacctcactgtcttatttttctcccagtgactcaattttgtttcttaatctcatactgaaatgtcttaggatcggacaacacgaggaatatatgatttgtgtgaattcactaaaagattggatcagagcccgaaagctgagactcatcaggcaagtcaacacgtgcctgattcactgcttatgaatttatgaacattatcatgttaagccagtgagaagtttgaacctggtagccgggtcctcttgtgacttcctagggcacaactttgtttataaacaaaaatgtaggttcccattgctgcacaaatttcagagtgacaccaactttgatgcattttatggaatttgtcaactttcttgtttcatcgttgctgattgttattcatatgattttcaggttacatcatcaactcctcgccctgctattgaatcctcagagagaattgctagggtaaaattattgggataccttacattttttgaaatttggatcttcactaattaatattttccccccacaggctggttctttgcccccagctttggaaccagagtctcctagaatagaggcgcctaaggtcaggtttggttcttgtttgagaacacaattgaccagtcttgttccatctgatataatctgcttttgtaggttgtgcgctcatctacaatcatgtcagcatcgggacttagtttgctagctggaactacaacaccacctaaaagagtaagacactgatcacctaaggtgctttgtgatttaaaattacttttttaggtgctccgtctaatgatcactgtgcacattggtaagacaataaatatacttgttgcttatgcaaatgcagcaggtaaataattttgttgcatatactcgatagatggaacatattaaagataactgtgtggtgcatgtcatatattgatagcatgttttgtttctgattctttactactgaaataagtgtatatatttattgtcaccttcatacctctctgtagcatattaactttgagcctactttggttccgctgtgctgtcacagtgtagttttttttcattgtgctttacattccaataacaaaaatggtaaaatctagtaatatataacattctgaaacaactatatatatatataactttaagtattcataaagaaacacaataataggggagactcggtgccagaggcttccacatgagtggggtttgagaaaggataaaccaaggcaagccttcccctgcaaatgcagagatgctgcttcgaacccgtgatctagtgattgtgacttagatggctctcaccactgcaccagacatggtaactcagtgaagcacaataatagctttaagaaaaatgtactgtttggctgttattcaactttgatccaatacactttcatctagctggacaagttagccctgctcatggggttaaacccgccctgtcccacagccaggggtggtaatggatcacaatccaaatgtttcttcataattcgtttgagcccctgattaattttagttcaaaagtgaatagaaatagagcccgatcctaatccaatccgattcataaattcatatattgtggtgtaaacaaattgacgcttagacaacttaataacacattgcggacgtttttaatgtactgaattaattcgagctcgccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcggggatctagagctcccagcttagcaagagatgttaattttttcagtaagctcttacagcttgttgtaaacacgcgctaaacggccgtggcctttgacagtcaccggtgattcgttggcggcaataaacgctgattcacccggtttaagctgtaactgctgagaacctttccacaacgttgcatcgccttcgacgcagaacaaaatggcggcactctgctggctaatggtggtttctttatcactaaggtcatgcagcgagaaggcaaaatcatccactggaatcgggaagtccagttctgcaccttgtttcaccggctgggtcaacaactggttagccggtttggcttcgaatttcacattggcaaccagttccggaatatcaatgtatttaggcgtcagacccgcacgcagcacgttatcggagtttgccatcacttccagcgccacgccttgcaggtaagcgtgcggtgtttcagcgaacaggaacatcgcttcgccagggttcaatttcaccacattcagcaatagcggggagaacagaccgctgtcttccgggtaaaattcagaaattaaacgaatcgtttgccacggttcaccctgctggctatcgagggccgattttaaaatcgccagcgcgcgggatttttcttcaccctgcatattcaacaggctggcgaacagttcgcttaaacgttcggcatcaggctgttgtaaaaagtgagcaatcgccggatgtgcacctgcgaccggctggagtagggagacaatctcggaaaattcacgaaacgcgttcatcgcaaggaaaggcgtcagcgcaaaaaccagctccggcttgtggttaggatctttatagttacgctcggcggcatccatcgggatacctgcggcattttctttggcaaaaccgatttcagaattgtgtttgtttggatgaacctgaatggagagtggctgtgctgcgcataatactttgaacaggaaaggcagttcgccaaagcgtttggcaacggcctctccgagcagagtcgatttatcactctcaatcacatcacgcagtgaaacgatatctccggcggcattctgcactcgtgaactgcttttcggatgtgcgcccatccacagctcggccatcggctggctggacggattttccataccataaagttcagtcaacgccgttttgctgccccaggcatagttttgcactgagttaatgagtttctgcatctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccgtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtactatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcaggaattccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcggggacctaggtcacagctcgtccttctcgctcaggctgcaggccggaatcctggcctcgttcacgatctgggtgaagccggccaggctgcacatgccctgggcgttcctctcctcgcagccggccagggtcagcttcacctcgcccggcggggtgttcaggaacagcggggtcttgtccctcatctgctgcagggtctggaacaccaggctcacctgaatccactggctgttgtcgctcagcctcctccacctctcgaacaccagctcgccgcccggcggggtgttgtccggctggcccggcagggtccactgcagctcgagggcgccgcccaggttggccaggttggtgtcgtggccggcgatgaacagcacgctggtcggcagggtcacgccgtaggcctgcttctgcggcgggtgcggggtcagggcggtcttgatcaggtccagcagcggggtggccctgctcctggccacctccggggtcctctgcagcaggtcgaactgggcgttgtgcaggctcagcagggtgttccactggtggctgtcggtgatcctgccccagcccggctccggcatgccctgggcctgctgcagcaggaaaatctcggtcagcatgctggccaggctccaggcgccggtcaggctcacgttgtcggcgctcaccttcagctcgctcggcagggcctgggtcaggctggcgctctcgtcctgcttctccctcttcagggccaggttgctctgcgggaagttcagcaccctctccagctccctgaaggcggtctggtagtggccggtgaagtcggcgatgctgccgccggccctctccaggatggcgtcggtcacctgggccacgtccagctggcacacgccggtcttcagcgggttgaacagcgggtccgggctgctggtgtcggcctgggtgtgcacggtgatggcgcagtccggggccaggccggcggcgaaggcctcaccggtcttcctggtcctctcgtccacgtcggcgatgatggccacctggccgctctgcgggcagcccttcttcggcagcaggccgtcggccaccagcctctgcctccagtagtggcccaggtaggcgatcagctcgccgcccctcggggtcagctcgcccagcttcaccggccaggtgtagaacgcgtccggggtcacgtcctgcatcagctgggtgaacttggtcggggccctcacgccgtgcctgctcacgatcaccacgctctccagcttcagctccggctcgctctgggcagaggtggcgctggcagcaagagccagcagggccagggccacgagcagcacgcgcatggtttaggatccggtgtcgatcgggttcttctgcgctctggagtagataaagctaatggtctgaagacccagtggtggtgatggagaagtgcacaggcatgcgagcgttatttatagctttgattaattaacacaatttcttgtgttcttatgccaccgagacggctgtaggcagcttcatggtttcttgccaaatgtatatgactcgtcactctctttacgtagcacgtcgatggttcatctggaatcattctgtacttctgcgtggctcagttttgttgccttctacaggttgttgatctacgtaaaacgaattagatttagcttgacatatggctttttttttgttgtaaatttactttacacgtcaaggatttttgtcctgttccggcctattttatttttcatgaaacgatctttgtaatgcaatatgagttgtttgtaatgtcttgtgagctgtaagcatgtatatcagatgagtatgatctcggcatgactcaccgtgtttctttgcacacagagaggatttgtttgattgtttcttacccaatacccttgacgtgcaattttggttgatgttctgtgagttgttaaggatacaacgaattcttggagctttacatgccaatgcatggttgtttcgtgttcctcaacatttaaggacttattcggttgcacctggatcgaaggggattgggagaaatcgattaaatctccttctatttaattttgactaggaagagatttaatcgtttccaacccctttcgatccagacgtaagcgaacaagttatttatttggatacctcttattcatcttaatacacacatggtattaagttgccactagtcatatgcctgtgcattgctacggtttatattatatatatatatatatatatatatatatatatatatatatatgataaattttgttttaataaaacatatgttttctattgattaggttgtgtgaatatgagccaacaaccaaggtccagaacacttatacataatttcaccttattttgtacataaactctcttattatagtagtaagagaagagattataagagtgcgggttgattataaagaaatgtaggagttttttaataatattgacacgagacgatcgttgaactggtgctttaatatagtaaagataaagattggtgttggggacttgttctcaaatgctatgaattaagaacaaggcaacataaaatgttaaatatcaaaatccttcgtccttcgaagcattattttcctttggatataatggatttcggacgaaggttatgaaggtcataccttcataatcataatcaaatgaaaaagtaaagaagattcacacataaaataatatgattactttggtacccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcggggacctaggtcacagctcgtccttctcgctcaggctgcaggccggaatcctggcctcgttcacgatctgggtgaagccggccaggctgcacatgccctgggcgttcctctcctcgcagccggccagggtcagcttcacctcgcccggcggggtgttcaggaacagcggggtcttgtccctcatctgctgcagggtctggaacaccaggctcacctgaatccactggctgttgtcgctcagcctcctccacctctcgaacaccagctcgccgcccggcggggtgttgtccggctggcccggcagggtccactgcagctcgagggcgccgcccaggttggccaggttggtgtcgtggccggcgatgaacagcacgctggtcggcagggtcacgccgtaggcctgcttctgcggcgggtgcggggtcagggcggtcttgatcaggtccagcagcggggtggccctgctcctggccacctccggggtcctctgcagcaggtcgaactgggcgttgtgcaggctcagcagggtgttccactggtggctgtcggtgatcctgccccagcccggctccggcatgccctgggcctgctgcagcaggaaaatctcggtcagcatgctggccaggctccaggcgccggtcaggctcacgttgtcggcgctcaccttcagctcgctcggcagggcctgggtcaggctggcgctctcgtcctgcttctccctcttcagggccaggttgctctgcgggaagttcagcaccctctccagctccctgaaggcggtctggtagtggccggtgaagtcggcgatgctgccgccggccctctccaggatggcgtcggtcacctgggccacgtccagctggcacacgccggtcttcagcgggttgaacagcgggtccgggctgctggtgtcggcctgggtgtgcacggtgatggcgcagtccggggccaggccggcggcgaaggcctcaccggtcttcctggtcctctcgtccacgtcggcgatgatggccacctggccgctctgcgggcagcccttcttcggcagcaggccgtcggccaccagcctctgcctccagtagtggcccaggtaggcgatcagctcgccgcccctcggggtcagctcgcccagcttcaccggccaggtgtagaacgcgtccggggtcacgtcctgcatcagctgggtgaacttggtcggggccctcacgccgtgcctgctcacgatcaccacgctctccagcttcagctccggctcgctctgggcagaggtggcgctggcagcaagagccagcagggccagggccacgagcagcacgcgcatggtttaggatccggtgtcgatcgggttcttctgcgctctggagtagataaagctaatggtctgaagacccagtggtggtgatggagaagtgcacaggcatgcgagcgttatttatagctttgattaattaacacaatttcttgtgttcttatgccaccgagacggctgtaggcagcttcatggtttcttgccaaatgtatatgactcgtcactctctttacgtagcacgtcgatggttcatctggaatcattctgtacttctgcgtggctcagttttgttgccttctacaggttgttgatctacgtaaaacgaattagatttagcttgacatatggctttttttttgttgtaaatttactttacacgtcaaggatttttgtcctgttccggcctattttatttttcatgaaacgatctttgtaatgcaatatgagttgtttgtaatgtcttgtgagctgtaagcatgtatatcagatgagtatgatctcggcatgactcaccgtgtttctttgcacacagagaggatttgtttgattgtttcttacccaatacccttgacgtgcaattttggttgatgttctgtgagttgttaaggatacaacgaattcttggagctttacatgccaatgcatggttgtttcgtgttcctcaacatttaaggacttattcggttgcacctggatcgaaggggattgggagaaatcgattaaatctccttctatttaattttgactaggaagagatttaatcgtttccaacccctttcgatccagacgtaagcgaacaagttatttatttggatacctcttattcatcttaatacacacatggtattaagttgccactagtcatatgcctgtgcattgctacggtttatattatatatatatatatatatatatatatatatatatatatatatgataaattttgttttaataaaacatatgttttctattgattaggttgtgtgaatatgagccaacaaccaaggtccagaacacttatacataatttcaccttattttgtacataaactctcttattatagtagtaagagaagagattataagagtgcgggttgattataaagaaatgtaggagttttttaataatattgacacgagacgatcgttgaactggtgctttaatatagtaaagataaagattggtgttggggacttgttctcaaatgctatgaattaagaacaaggcaacataaaatgttaaatatcaaaatccttcgtccttcgaagcattattttcctttggatataatggatttcggacgaaggttatgaaggtcataccttcataatcataatcaaatgaaaaagtaaagaagattcacacataaaataatatgattactttggtacccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcggggacctaggtcacagctcgtccttctcgctcaggctgcaggccggaatcctggcctcgttcacgatctgggtgaagccggccaggctgcacatgccctgggcgttcctctcctcgcagccggccagggtcagcttcacctcgcccggcggggtgttcaggaacagcggggtcttgtccctcatctgctgcagggtctggaacaccaggctcacctgaatccactggctgttgtcgctcagcctcctccacctctcgaacaccagctcgccgcccggcggggtgttgtccggctggcccggcagggtccactgcagctcgagggcgccgcccaggttggccaggttggtgtcgtggccggcgatgaacagcacgctggtcggcagggtcacgccgtaggcctgcttctgcggcgggtgcggggtcagggcggtcttgatcaggtccagcagcggggtggccctgctcctggccacctccggggtcctctgcagcaggtcgaactgggcgttgtgcaggctcagcagggtgttccactggtggctgtcggtgatcctgccccagcccggctccggcatgccctgggcctgctgcagcaggaaaatctcggtcagcatgctggccaggctccaggcgccggtcaggctcacgttgtcggcgctcaccttcagctcgctcggcagggcctgggtcaggctggcgctctcgtcctgcttctccctcttcagggccaggttgctctgcgggaagttcagcaccctctccagctccctgaaggcggtctggtagtggccggtgaagtcggcgatgctgccgccggccctctccaggatggcgtcggtcacctgggccacgtccagctggcacacgccggtcttcagcgggttgaacagcgggtccgggctgctggtgtcggcctgggtgtgcacggtgatggcgcagtccggggccaggccggcggcgaaggcctcaccggtcttcctggtcctctcgtccacgtcggcgatgatggccacctggccgctctgcgggcagcccttcttcggcagcaggccgtcggccaccagcctctgcctccagtagtggcccaggtaggcgatcagctcgccgcccctcggggtcagctcgcccagcttcaccggccaggtgtagaacgcgtccggggtcacgtcctgcatcagctgggtgaacttggtcggggccctcacgccgtgcctgctcacgatcaccacgctctccagcttcagctccggctcgctctgggcagaggtggcgctggcagcaagagccagcagggccagggccacgagcagcacgcgcatggtttaggatccggtgtcgatcgggttcttctgcgctctggagtagataaagctaatggtctgaagacccagtggtggtgatggagaagtgcacaggcatgcgagcgttatttatagctttgattaattaacacaatttcttgtgttcttatgccaccgagacggctgtaggcagcttcatggtttcttgccaaatgtatatgactcgtcactctctttacgtagcacgtcgatggttcatctggaatcattctgtacttctgcgtggctcagttttgttgccttctacaggttgttgatctacgtaaaacgaattagatttagcttgacatatggctttttttttgttgtaaatttactttacacgtcaaggatttttgtcctgttccggcctattttatttttcatgaaacgatctttgtaatgcaatatgagttgtttgtaatgtcttgtgagctgtaagcatgtatatcagatgagtatgatctcggcatgactcaccgtgtttctttgcacacagagaggatttgtttgattgtttcttacccaatacccttgacgtgcaattttggttgatgttctgtgagttgttaaggatacaacgaattcttggagctttacatgccaatgcatggttgtttcgtgttcctcaacatttaaggacttattcggttgcacctggatcgaaggggattgggagaaatcgattaaatctccttctatttaattttgactaggaagagatttaatcgtttccaacccctttcgatccagacgtaagcgaacaagttatttatttggatacctcttattcatcttaatacacacatggtattaagttgccactagtcatatgcctgtgcattgctacggtttatattatatatatatatatatatatatatatatatatatatatatatgataaattttgttttaataaaacatatgttttctattgattaggttgtgtgaatatgagccaacaaccaaggtccagaacacttatacataatttcaccttattttgtacataaactctcttattatagtagtaagagaagagattataagagtgcgggttgattataaagaaatgtaggagttttttaataatattgacacgagacgatcgttgaactggtgctttaatatagtaaagataaagattggtgttggggacttgttctcaaatgctatgaattaagaacaaggcaacataaaatgttaaatatcaaaatccttcgtccttcgaagcattattttcctttggatataatggatttcggacgaaggttatgaaggtcataccttcataatcataatcaaatgaaaaagtaaagaagattcacacataaaataatatgattactttggtacccaattcccgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcggggaaattcggggacctaggtcacagctcgtccttctcgctcaggctgcaggccggaatcctggcctcgttcacgatctgggtgaagccggccaggctgcacatgccctgggcgttcctctcctcgcagccggccagggtcagcttcacctcgcccggcggggtgttcaggaacagcggggtcttgtccctcatctgctgcagggtctggaacaccaggctcacctgaatccactggctgttgtcgctcagcctcctccacctctcgaacaccagctcgccgcccggcggggtgttgtccggctggcccggcagggtccactgcagctcgagggcgccgcccaggttggccaggttggtgtcgtggccggcgatgaacagcacgctggtcggcagggtcacgccgtaggcctgcttctgcggcgggtgcggggtcagggcggtcttgatcaggtccagcagcggggtggccctgctcctggccacctccggggtcctctgcagcaggtcgaactgggcgttgtgcaggctcagcagggtgttccactggtggctgtcggtgatcctgccccagcccggctccggcatgccctgggcctgctgcagcaggaaaatctcggtcagcatgctggccaggctccaggcgccggtcaggctcacgttgtcggcgctcaccttcagctcgctcggcagggcctgggtcaggctggcgctctcgtcctgcttctccctcttcagggccaggttgctctgcgggaagttcagcaccctctccagctccctgaaggcggtctggtagtggccggtgaagtcggcgatgctgccgccggccctctccaggatggcgtcggtcacctgggccacgtccagctggcacacgccggtcttcagcgggttgaacagcgggtccgggctgctggtgtcggcctgggtgtgcacggtgatggcgcagtccggggccaggccggcggcgaaggcctcaccggtcttcctggtcctctcgtccacgtcggcgatgatggccacctggccgctctgcgggcagcccttcttcggcagcaggccgtcggccaccagcctctgcctccagtagtggcccaggtaggcgatcagctcgccgcccctcggggtcagctcgcccagcttcaccggccaggtgtagaacgcgtccggggtcacgtcctgcatcagctgggtgaacttggtcggggccctcacgccgtgcctgctcacgatcaccacgctctccagcttcagctccggctcgctctgggcagaggtggcgctggcagcaagagccagcagggccagggccacgagcagcacgcgcatggtttaggatccggtgtcgatcgggttcttctgcgctctggagtagataaagctaatggtctgaagacccagtggtggtgatggagaagtgcacaggcatgcgagcgttatttatagctttgattaattaacacaatttcttgtgttcttatgccaccgagacggctgtaggcagcttcatggtttcttgccaaatgtatatgactcgtcactctctttacgtagcacgtcgatggttcatctggaatcattctgtacttctgcgtggctcagttttgttgccttctacaggttgttgatctacgtaaaacgaattagatttagcttgacatatggctttttttttgttgtaaatttactttacacgtcaaggatttttgtcctgttccggcctattttatttttcatgaaacgatctttgtaatgcaatatgagttgtttgtaatgtcttgtgagctgtaagcatgtatatcagatgagtatgatctcggcatgactcaccgtgtttctttgcacacagagaggatttgtttgattgtttcttacccaatacccttgacgtgcaattttggttgatgttctgtgagttgttaaggatacaacgaattcttggagctttacatgccaatgcatggttgtttcgtgttcctcaacatttaaggacttattcggttgcacctggatcgaaggggattgggagaaatcgattaaatctccttctatttaattttgactaggaagagatttaatcgtttccaacccctttcgatccagacgtaagcgaacaagttatttatttggatacctcttattcatcttaatacacacatggtattaagttgccactagtcatatgcctgtgcattgctacggtttatattatatatatatatatatatatatatatatatatatatatatatgataaattttgttttaataaaacatatgttttctattgattaggttgtgtgaatatgagccaacaaccaaggtccagaacacttatacataatttcaccttattttgtacataaactctcttattatagtagtaagagaagagattataagagtgcgggttgattataaagaaatgtaggagttttttaataatattgacacgagacgatcgttgaactggtgctttaatatagtaaagataaagattggtgttggggacttgttctcaaatgctatgaattaagaacaaggcaacataaaatgttaaatatcaaaatccttcgtccttcgaagcattattttcctttggatataatggatttcggacgaaggttatgaaggtcataccttcataatcataatcaaatgaaaaagtaaagaagattcacacataaaataatatgattactttggtaccttgattccatggatttggtacgtaccagtaactcgagttagacttaattaagctgagtggctccttcaacgttgcggttctgtcagttccaaacgtaaaacggcttgtcccgcgtcatcggcgggggtcataacgtgactcccttaattctccgctcatgatcaggttgtcgtttcccgccttcagtttaaactatcagtgttcactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctggacacgttcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccaaagtaatcatattattttatgtgtgaatcttctttactttttcatttgattatggttatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccaaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccggatcctaaaccatgcgcgtgctgctcgtggccctggccctgctggctcttgctgccagcgccacctctgcccagagcgagccggagctgaagctggagagcgtggtgatcgtgagcaggcacggcgtgagggccccgaccaagttcacccagctgatgcaggacgtgaccccggacgcgttctacacctggccggtgaagctgggcgagctgaccccgaggggcggcgagctgatcgcctacctgggccactactggaggcagaggctggtggccgacggcctgctgccgaagaagggctgcccgcagagcggccaggtggccatcatcgccgacgtggacgagaggaccaggaagaccggtgaggccttcgccgccggcctggccccggactgcgccatcaccgtgcacacccaggccgacaccagcagcccggacccgctgttcaacccgctgaagaccggcgtgtgccagctggacgtggcccaggtgaccgacgccatcctggagagggccggcggcagcatcgccgacttcaccggccactaccagaccgccttcagggagctggagagggtgctgaacttcccgcagagcaacctggccctgaagagggagaagcaggacgagagcgccagcctgacccaggccctgccgagcgagctgaaggtgagcgccgacaacgtgagcctgaccggcgcctggagcctggccagcatgctgaccgagattttcctgctgcagcaggcccagggcatgccggagccgggctggggcaggatcaccgacagccaccagtggaacaccctgctgagcctgcacaacgcccagttcgacctgctgcagaggaccccggaggtggccaggagcagggccaccccgctgctggacctgatcaagaccgccctgaccccgcacccgccgcagaagcaggcctacggcgtgaccctgccgaccagcgtgctgttcatcgccggccacgacaccaacctggccaacctgggcggcgccctcgagctgcagtggaccctgccgggccagccggacaacaccccgccgggcggcgagctggtgttcgagaggtggaggaggctgagcgacaacagccagtggattcaggtgagcctggtgttccagaccctgcagcagatgagggacaagaccccgctgttcctgaacaccccgccgggcgaggtgaagctgaccctggccggctgcgaggagaggaacgcccagggcatgtgcagcctggccggcttcacccagatcgtgaacgaggccaggattccggcctgcagcctgagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatccctacccacaactcatggtacaaaattaccaacctaacctcacccataaatgatgctcttcaatagggttggcattcggttttttgaaacttcggttcggttctttggttttaaaaaacttcggggtttcaaatattagaagccgatcggttttctagaaaatgaaaaaccgataagttcggtttcggttttttactttggttttttcggtaaaaaccgaataccaaacttatactcaagaaggctacaaggcaacacattacgcacaattttaaaaagtaaaaattatataggtacaaatatttaaatatatatcatacatcacatacaaacaagtgaataacaatttgattgcatcacacatttagttcacataatcaaagagtcgatttgtttaattgataatgtttggtattcggtttttttgtatttcggttcggtatacggtgaaaaccgattacgataccgaataccaaaattctcagatgtaaaaaccgaatccgaactaccaaaaaaccgaaatttcggttcggttcggttcggtacgcttcagttttcggtttacggtaaaaaagtgcccaccctactcttcaatccaccccaacggcccaacctgccccaccattgcgggtatgctatgggttgtgtttcatagtctgctcctagcaggcagccgcagacagtgagcacttaggagggagctgcgatgtcgagccgccggttgatctccttgtccgtgagaggtgaagtgggcacagtagatgcagaaagccttgcaccatcctgggttcacggggtcactagtgatgactccgtgtctgccgcacaagagcctgacccagcgagtgcttgaaacccctccacgaactgcagaaatgttgaatccgaataaagcaaagcaagaagctactactgacatttttatgaagaaaatataagtcattcttggactgatttacaccgtggaagatcccaggccgccacctagggttagtgaggtggttggcctccaggatggtggcgtccagagtgcggtgcagcagcagatgcgtcatggatgcacgcctgtacctccacttcctccttagatcacttgtgcaagacaacttcacctgggagatagaggcctatcagctttcatcaaaagtgcatagcgtggcaagagataaaggatgactaattttggatatgattcagagctagagaatttgggaagaaattaagagagggaattagtacaagatagaccagaaacatggagcactgcattgccaagtgccaacgaactgcagagtgtgctccaatcctagcaagaaaaggaaagggcagcgagaaagggaagggtaaaagaatgatgcaaaggagcagatgaggggcaagacgcgcctagatctaacgtctaggcatggaagcggcggtagaggtagggtggcgtcacccctatggccgcggaaggcccgagcgaggcaatcgggaagatgactcaaatcaacccgctccatcccaacccaaacccgcctatgtagaaaacccgccccgccctagctaccaaaacccatttccacccatccaaataaactctatatcaaaaccaaacccataaaacctattctaaggttgtctctagcagatcatgtataatgtcgtgcaaaacactattttgcactgcatacatcactattcacggagtggagtttgaaataggaggtgagaggtcgtctctagcaagttacccatcctctctcctatctcatcttctatttcaaactttactttgtgaacagtgcaaaacagtgtttttgtgtgaccatatgcatgatttgttggagatagcctaaggctatggccaacagaccgtacatatggtcgtacaaaacattgttttgcactgtttacagagtaaagtttgaaataagggataggatgagtaacaatgctggatatatagcataacccaccccattagcaggcctggacaagtatcatgtgttcagtgtttacttcattacttgtagagatagtgtgtgccatctgatgtactccctcaattctttgctatttgtcgcgttttagttcaaaaatgtactaacgggcgacaaatattcgagaacggagttagtattaatttgcattcatgcagcgatataattaagagttgcaatttcttttgttgaacttaaaccttgatttgcctacactcagaatttgcagtataagttattagtaactctcttgcatatgcaggaccagccgggtgctttcagcagaacaagttcaatgaaggaaggatcctctgagttaccgagtggtgtccgaagctcagcagaaccaagccccaggagatctggcggttcaaccctttttggagggcttggttttctaaggagctacaccagctgagacgtatgtgctcagatacgtgaatttttattcagactccatcagcttgagctgcatatgtaggtagtagaaaacatggcagttgccaaaaggatggctcccttttccaattgggaattgcgaatttttgtaggaacttaataccttgcagggcaatgcctggagggttgtatattgcactggattatactagtagaatacatgtttggcaaggagcagttgcaactaaatttgtgcttttcttggactcaaacctgctggctgatgatgcttgcttggatagcatgtatgcaacatttgttgtggcagctgcaggctgcaggcatatctggaaactctggatccactcacggttggatttccacccagtacttggtctgatatgtgatatggacaagacgttatgatccgcaacgtccatgcataaaaatcaattgtgtgtttggttcagctttctaaattcgatttgctgccaaaaatcagtaatctaaatctcaactaaatgggtgcaacaaaataatagatttctgaatgaccgatgccattcattttgtagattcctatcatacatgtttaccaagctatcagcaaaccgttagtttaggaatctgctttcgaacagacctgagcttgttgtctcaacctcattgttctacacttacctataacaatgctttttaagaccatatttttgcaatactgtaatttacaattattacatcctaataactttctcataactagaatcaaatttcagtaacccacattcgaacagacccgagcttgctgtactcaacatcattgttctacacttacatataacaattctttttaaaaccatatttttataataatgtagtttgcaattattgtcacagtcatagttttagttggcttcaaaaataaatacaatggtttagatataatattgtagaccattgtatttagatgttataaaaactttatgctaaatagcacaatcttcatctctactatattaaagcaccagtttcaacggtctttccacatcatccttccctcttaatgcaaaaataaaataaaattatgtataaatgatggtttgaaaaccttagttgttggctcaaccaatagaacgggcaatgttttgtgtcataataaaacgaagtctactcatatgatatatagaaatcgtgacaaagtacggacaactaactattagtttgaaaacacagttttaaaaaatgcaaccgaacctcttattgattgtataaaatactatagtaaaccataaaatttctctataaactataaaaaatattttacttctaaatagatctttgttgcatatttttaaaggtaaatcctttatttcttgcctcaagttaggtgtagtatcaataattaaacatcatagcatatgttgtagcctcagatcagctgtagcatgaataagtaagcataatcatcgcatatgtccaattatcaattgtgatgtatatttcagtaatgataaaataagacaacataaggtatagagtttaattggttgtctggacctggagaagtcctaaaaggaagaagaaaaaaaagcaaagagtgaaatcatttgttgcaagcaaatcagaggaaaaataagatcatcaccggccctttttcgattcctcacaataagtttggtaaaagagaacaactcggttcttagcctaactagtcaacattaatgttttttgggcttgatgatgcttctttcttggggctttattaaacggggtatcatgtatattttggcgagatgattttaaataaaaaacatataacggctcgtttggatccttagaatt

SEQ ID NO: 176 - DNA, 112 bp, Artificial Sequence
  Synthetic construct, PY209 (513+889)
aaacgtccgcaatgtgttattaagttgtctaagcgtcaatttgtttacctcatgtagaaaagcatatatgcaccttctgacataacttgattcactgatacaacctggacct

SEQ ID NO: 177 - DNA, 179 bp, Artificial Sequence
  Synthetic construct, PY1053 loc1(513+887)
cgctcgaattgttgcatgttgagaagtacccatatatagcggctagctgcagctagtctcttgctaaaaatcagctgtaaagtcattcgaggatagaaaacaaaagagccatgaaaaggatatattgtggtgtaaacaaattgacgcttagacaacttaataacacattgcggacgttt

SEQ ID NO: 178 - DNA, 227 bp, Artificial Sequence
  Synthetic construct, PY1053 loc2 (513+886)
aaacgtccgcaatgtgttattaagttgtctaagcgtcaatttgtttacaccacaaaagagctagagtggatgggtgggggggacaaatgaaaacaagcgtacgacatcaccagcaccagcaacaataacttaaccacaacacaacaacgacgcccgattattaaacgcggtacaagcgagggcataaaagaaaaaagagggatccccaaaggaggaatggagaggga

SEQ ID NO: 179 - DNA, 228 bp, Artificial Sequence
  Synthetic construct, PY1203 loc1 (855+890)
atgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgttgtttcaaccctcatagtcatagaagccacctatcttgacca

SEQ ID NO: 180 - DNA, 182 bp, Artificial Sequence
  Synthetic construct, PY1203 loc2 (855+908)
atactaaaaaggcacgaccgtcaaagccgctagattcgtcaacatgtactgaattaattcgagctcgccaattcccgatctagtaacatagatgacaccgcgcgcgataatttatcctagtttgcgcgctatattttgttttctatcgcgtattaaatgtataattgcgggactctaatcat

SEQ ID NO: 181 - DNA, 6189 bp, Artificial Sequence
  Synthetic construct, pAG4295
tacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaagttcacgcagctcatgcaggacgtgaccccggacgccttctacacctggccggtgaagctcggcgagctgaccccgcgcggcggcgagctgatcgcctacctcggccactactggcgccagcgcctcgtggccgacggcctcctcccgaagaagggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacgtggcccaggtgaccgacgccatcctggagcgcgccggcggctccatcgccgacttcaccggccactaccagaccgccttccgcgagctggagcgcgtgctcaacttcccgcagtcgaacctcgccctcaagcgcgagaagcaggacgagtccgcctccctcacccaggccctcccgtccgagctgaaggtgtccgccgacaacgtgtccctcaccggcgcctggtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgcagtggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctcttcctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgttaattaagtctaactcgagttactggtacgtatacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctggatccaccatgagggtgttgctcgttgccctcgctctcctggctctcgctgcgagcgccaccagcgctgcgcagtccgagccggagctgaagctggagtccgtggtgatcgtgtcgcgccacggggtgcgcgccccgaccaagttcacgcagctcatgcaggacgtgaccccggacgccttctacacctggccggtgaagctcggcgagctgaccccgcgcggcggcgagctgatcgcctacctcggccactactggcgccagcgcctcgtggccgacggcctcctcccgaagaagggctgcccgcagtccggccaggtggcgatcatcgccgacgtggacgagcgcacccgcaagacgggcgaggccttcgccgccggcctcgccccggactgcgccatcaccgtgcacacccaggccgacacctcctccccggacccgctcttcaacccgctcaagaccggcgtgtgccagctcgacgtggcccaggtgaccgacgccatcctggagcgcgccggcggctccatcgccgacttcaccggccactaccagaccgccttccgcgagctggagcgcgtgctcaacttcccgcagtcgaacctcgccctcaagcgcgagaagcaggacgagtccgcctccctcacccaggccctcccgtccgagctgaaggtgtccgccgacaacgtgtccctcaccggcgcctggtccctcgcctccatgctcaccgaaatcttcctcctccagcaggcccagggcatgccggagccgggctggggccgcatcaccgactcccaccagtggaacaccctcctctccctccacaacgcccagttcgacctcctccagcgcaccccggaggtggcccgctcccgcgccaccccgctcctcgacctcatcaagaccgccctcaccccgcacccgccgcagaagcaggcctacggcgtgaccctcccgacctcggtgctcttcatcgccggccacgacaccaacctcgccaacctcggcggcgccctggagctgcagtggaccctcccgggccagccggacaacaccccgccgggcggcgagctggtgttcgagcgctggcgccgcctctccgacaactcccagtggattcaggtgtccctcgtgttccagaccctccagcagatgcgcgacaagaccccgctcttcctcaacaccccgccgggcgaggtgaagctcaccctggccggctgcgaggagcgcaacgcgcagggcatgtgctccctcgccggcttcacccagatcgtgaacgaggcccgcatcccggcctgctccctctccgagaaggacgagctgtaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaat

SEQ ID NO: 182 - DNA, 138 bp, Artificial Sequence
  Synthetic construct, PY209Loc2 (456+889)
gagctcgaattaattcagtacattaaaaacgtccgcaatgtgttattaagttgtctaagcgtcaatttgtttacctcatgtagaaaagcatatatgcaccttctgacataacttgattcactgatacaacctggacct

SEQ ID NO: 183 - DNA, 159 bp, Artificial Sequence
  Synthetic construct, PY1053 T-DNA loc (505+925)
tgttactagatcgggaattggcgagctcgaattaattcagtacattaaaaacgtccgcaatgtgttattaagttgtctaagcgtcaatttgtttacaccacaaaagagctagagtggatgggtgggggggacaaatgaaaacaagcgtacgacatcacc

SEQ ID NO: 184 - DNA, 112 bp, Artificial Sequence
  Synthetic construct, PY1203 T-DNA locus (456+890)
gagctcgaattaattcagtacattaaaaacgtccgcaatgtgttattaagttgtctaagcgtcaatttgttgtttcaaccctcatagtcatagaagccacctatcttgacca

SEQ ID NO: 185 - protein, 7 aa, Artificial Sequence
  Synthetic construct, phytase conserved motif
  misc_feature (4)..(4): Xaa can be any naturally occurring amino acid
  misc_feature (6)..(6): Xaa can be any naturally occurring amino acid
RHGXRXP

What is claimed is:

1. A maize plant or part thereof comprising one or more synthetic nucleic acids encoding a phytase and synthetic polynucleotides of SEQ ID NON: 158 and SEQ ID NO: 159, wherein the one or more synthetic nucleic acids encoding said phytase comprise a sequence with at least 90% identity to the nucleic acid sequence of SEQ ID NO: 17 and the synthetic polynucleotides of SEQ ID NO: 158 and SEQ ID NO: 159 produce an amplicon diagnostic for event PY1203 and wherein a representative sample of seed comprising event PY1203 has been deposited under ATCC Accession No. PTA-127093.

* * * * *